US008728803B2

(12) United States Patent
Thompson et al.

(10) Patent No.: US 8,728,803 B2
(45) Date of Patent: May 20, 2014

(54) **THERMOPHILIC AND THERMOACIDOPHILIC METABOLISM GENES AND ENZYMES FROM *ALICYCLOBACILLUS ACIDOCALDARIUS* AND RELATED ORGANISMS, METHODS**

(75) Inventors: Vicki S. Thompson, Idaho Falls, ID (US); William A. Apel, Jackson, WY (US); David W. Reed, Idaho Falls, ID (US); Brady D. Lee, Idaho Falls, ID (US); David N. Thompson, Idaho Falls, ID (US); Francisco F. Roberto, Idaho Falls, ID (US); Jeffrey A. Lacey, Idaho Falls, ID (US)

(73) Assignee: Battelle Energy Alliance, LLC, Idaho Falls, ID (US)

( * ) Notice: Subject to any disclaimer, the term of this patent is extended or adjusted under 35 U.S.C. 154(b) by 0 days.

(21) Appl. No.: 12/380,551

(22) Filed: Feb. 26, 2009

(65) Prior Publication Data

US 2009/0269827 A1   Oct. 29, 2009

Related U.S. Application Data

(60) Provisional application No. 61/032,339, filed on Feb. 28, 2008.

(51) Int. Cl.
*C12N 15/67* (2006.01)
*C12N 15/63* (2006.01)
*C07H 21/04* (2006.01)

(52) U.S. Cl.
USPC ........................................ 435/320.1; 530/350

(58) Field of Classification Search
None
See application file for complete search history.

(56) References Cited

U.S. PATENT DOCUMENTS

| | | | |
|---|---|---|---|
| 4,237,226 A | 12/1980 | Grethlein | |
| 4,581,333 A | 4/1986 | Kourilsky et al. | |
| 4,624,922 A | 11/1986 | Horikoshi et al. | |
| 5,098,825 A | 3/1992 | Tchen et al. | |
| 5,882,905 A | 3/1999 | Saha et al. | |
| 5,916,795 A | 6/1999 | Fukunaga et al. | |
| 5,948,667 A | 9/1999 | Cheng et al. | |
| 6,083,733 A | 7/2000 | Gronberg et al. | |
| 6,268,197 B1 | 7/2001 | Schulein et al. | |
| 6,426,211 B1 | 7/2002 | De Buyl et al. | |
| 6,506,585 B2 | 1/2003 | Danielsen et al. | |
| 6,777,212 B2 | 8/2004 | Asakura et al. | |
| 6,833,259 B2 | 12/2004 | Bhosle et al. | |
| 7,727,755 B2 | 6/2010 | Thompson et al. | |
| 2003/0134395 A1 | 7/2003 | Shetty | |
| 2003/0233674 A1 | 12/2003 | Gabor et al. | |
| 2003/0233675 A1 | 12/2003 | Cao et al. | |
| 2004/0029129 A1 | 2/2004 | Wang et al. | |
| 2005/0112742 A1 | 5/2005 | Thompson et al. | |
| 2006/0105442 A1 | 5/2006 | Wu et al. | |
| 2006/0211083 A1 | 9/2006 | Katzen et al. | |
| 2007/0082381 A1 | 4/2007 | Wilting et al. | |
| 2007/0134778 A1 | 6/2007 | Benning et al. | |
| 2007/0148728 A1 | 6/2007 | Johnson et al. | |
| 2009/0203107 A1 | 8/2009 | Thompson et al. | |
| 2009/0215168 A1 | 8/2009 | Lee et al. | |
| 2009/0221049 A1 | 9/2009 | Shaw et al. | |
| 2009/0226978 A1 | 9/2009 | Thompson et al. | |
| 2009/0253205 A1 | 10/2009 | Thompson et al. | |
| 2009/0263859 A1 | 10/2009 | Thompson et al. | |
| 2010/0203583 A1 | 8/2010 | Thompson et al. | |
| 2010/0311110 A1 | 12/2010 | Thompson et al. | |
| 2011/0081683 A1 | 4/2011 | Thompson et al. | |
| 2011/0275135 A1 | 11/2011 | Lee et al. | |

FOREIGN PATENT DOCUMENTS

| | | |
|---|---|---|
| DE | 197 17 893 A1 | 1/1999 |
| WO | 81/00577 | 3/1981 |
| WO | 99/06584 A1 | 2/1999 |
| WO | 03/068926 A2 | 8/2003 |
| WO | 2005/066339 A2 | 7/2005 |
| WO | 2006/117247 A1 | 11/2006 |

OTHER PUBLICATIONS

Schwermann, B. et al., 1994, Purification, properties and structural aspects of a thermoacidophilic alpha-amylase from *Alicyclobacillus acidocaldarius* ATCC 27009, insight into acidostability of proteins. Eur. J. Biochem. 226: 981-991.
Tsao, GR, MR Ladisch, and HR Bungay, 1987. Biomass Refining, in Advanced Biochemical Engineering, Wiley Interscience, N.Y., 79-101.
Lucas et al., C4-Dicarboxylate Transporter/Malic Acid Transport Protein [*Alicyclobacillus acidocaldarius* LAA1], GenBank Direct Submission, Accession No. EED06059, Dec. 17, 2008 (Retrieved from the Internet Dec. 15, 2009: <URL:http://www.ncbl.nlm.nlh.gov/protein/218238848), p. 2.
PCT International Search Report and Written Opinion of the International Searching Authority for PCT/US09/34701, dated Jan. 12, 2010, 10 pages.
PCT International Search Report and Written Opinion of the International Searching Authority for PCT/US09/35331, dated Feb. 23, 2010, 10 pages.
PCT International Search Report and Written Opinion of the International Searching Authority for PCT/US09/35275, dated Feb. 25, 2010, 13 pages.
GenBank: E17054.1 Direct Submission *Alicyclobacillus acidocaldarius* genomic DNA clone pOP3 containing acyl carrier protein gene. Nov. 5, 2005 [Retrieved from the Internet Jan. 23, 2010: http://www.ncbi.nlm.nih.gov/nuccore/E17054.1?ordinalpos=2 &tool=EntrezSystem2.PEntrez.Sequence.Sequence_ResultsPanel. Sequence_RVDocSum], 3 pages.
GenBank: E17054.1 Direct Submission *Alicyclobacillus acidocaldarius* genomic DNA clone pOP3 containing acyl carrier protein gene. Nov. 5, 2005 [Retrieved from the Internet Jan. 23, 2010: http://www.ncbi.nlm.nih.gov/nuccore/E17054.1?ordinalpos=2 &tool=EntrezSystem2.PEntrez.Sequence.Sequence_ResultsPanel. Sequence_RVDocSum], 1 page.

(Continued)

*Primary Examiner* — Padma V Baskar
(74) *Attorney, Agent, or Firm* — TraskBritt

(57) ABSTRACT

Isolated and/or purified polypeptides and nucleic acid sequences encoding polypeptides from *Alicyclobacillus acidocaldarius* are provided. Further provided are methods for modulating or altering metabolism in a cell using isolated and/or purified polypeptides and nucleic acid sequences from *Alicyclobacillus acidocaldarius*.

7 Claims, 141 Drawing Sheets

(56) References Cited

OTHER PUBLICATIONS

Hulsmann et al., "Maltose and maltodextrin transport in the thermoacidophilic gram-positive bacterium *Alicyclobacillus acidocaldarius* is mediated by a high-affinity transport system that includes a maltose binding protein tolerant to low pH," J. Bacteriol. 2000, 182(22):6292-6301.

Jones et al., "Cloning and transcriptional analysis of the *Thermoanaerobacter ethanolicus* strain 39E maltose ABC transport system," Extremophiles 2002, 6:291-299.

Schafer et al., "X-ray Structures of the Maltose-Maltodextrin-binding Protein of the Thermoacidophilic Bacterium *Alicyclobacillus acidocaldarius* Provide Insight into Acid Stability of Proteins," J. Mol. Biol. 2004, 335:261-274.

Scheffel et al., "Functional reconstitution of a maltrose ATP-binding cassette transporter from the thermoacidophilic gram-positive bacterium *Alicyclobacillus acidocaldarius*," Biochem Biophy Acta, 2004, 1656(1):57-65.

Schneider, "Import of solutes by ABC transporters—the maltose system. ABC protein: from bacteria to man," Elsevier Science, London 2003, p. 157-185. [Retrieved from the Internet on Jan. 24, 2010; <http://www2.hu-berlin.de/biologie/baktphys/paper/1_ABC/review_chap-09.pdf].

Uniprot Direct submission Q9RHZ5_ALIAC, "Putative maltose transport membrane protein malF," Nov. 13, 2007. [Retrieved from the Internet Jan. 22, 2010: <http://www.uniprot.org/uniprot/Q9RHZ5.txt?version=30?].

Lauro et al., "Isolation and characterization of a new family 42 beta-galactosidase from the thermoacidophilic bacterium *Alicyclobacillus acidocaldarius*: Identification of the active site residues," Biochimica et Biophysica Acta 1784 (2008) 292-301.

PCT International Search Report and Written Opinion of the International Search Authority for PCT/US09/35307, dated Jun. 10, 2010, 10 pages.

Broun et al. "Catalytic Plasticity of Fatty Acid Modification Enzymes Underlying Chemical Diversity of Plant Lipids" Science vol. 282 Nov. 13, 1998 pp. 1315-1317 (4 pages).

Devos et al. "Practical Limits of Functiona Prediction" Proteins: Structure, Function, and Genetics 41 (2000) pp. 98-107 (10 pages).

Seffernick et al. "Melamine Deaminase and Atrazine Chlorohydrolase: 98 Percent Identical but Functionally Different" Journal of Bacteriology vol. 183, No. 8, Apr. 2001 pp. 2045-2410 (6 pages).

Whisstock et al. "Prediction of Protein Function from Protein Sequence and Structure" Quarlty Reviews of Biophysics 36, 3 (2003) pp. 307-340 (35 pages).

Witkowski et al. "Conversion of a β-Ketoacyl Synthase to a Malonyl Decarboxylase by Replacement of the Active-Site Cysteine with Glutamine" American Chemical Society, Biochemistry, vol. 38, No. 36, 1999 pp. 11643-11650 (8 pages).

International Search Report and Written Opinion of the International Search Authority for PCT/US09/32333, mailed Jun. 19, 2009, 9 pages.

UniProtKB/TrEMBL Q9JRQ1 [online]. Oct. 1, 2000. Available on the internet at <<URL://http://www.uniprot.org/uniprot/Q9JRQ1>>.

PCT International Search Report and Written Opinion of the International Searching Authority for PCT/US09/00442, dated May 18, 2009, 8 pages.

Barany, F., 1911, PNAS. USA, 88: 189-193.
Bertoldo et al., 2004, Eng. Life Sci., 4, No. 6.
BLAST Search of Seq. ID. 36, accessed Apr. 22, 2009, 54 pages.
BLAST Search of Seq. ID. 456, accessed Apr. 22, 2009, 48 pages.
BLAST Search of Seq. ID. 458, accessed Apr. 22, 2009, 59 pages.
BLAST Search of Seq. ID. 460, accessed Apr. 22, 2009, 37 pages.
BLAST Search of Seq. ID. 462, accessed Apr. 22, 2009, 35 pages.
BLAST Search of Seq. ID. 464, accessed Apr. 22, 2009, 45 pages.
Borman, S., 2006, Glycosylation Engineering. Chem. Eng. News, 84(36): 13-22.
Buckholz, R. G., 1993, Yeast systems for the expression of heterologous gene products. Curr. Op. Biotechnology 4: 538-542.
Burg, J. L. et al., 1996, Mol. and Cell. Probes, 10: 257-271.
Chu, B. C. F. et al., 1986, NAR, 14: 5591-5603.
Collins et al., "Xylanases, Xylanase Families and Extremophilic Xylanses," FEMS Microbiology Review, 2005, pp. 3-23.
Duck, P. et al., 1990, Biotechniques, 9: 142-147.
Eckert et al., "A Thermoacidophilic Endoglucanase (CelB), etc.," Eur. J. Biochem. 270, 2003, pp. 3593-3602.
Eckert et al., "Gene cloning, sequencing, and characterization of a family 9 endoglucanase (CelA) with an unusual pattern of activity from the theremoacidophile *Alicyclobacillus acidocaldarius* ATCC27009," Applied Microbiology and Biotechnology, vol. 60, No. 4, Dec. 2002, pp. 428-436.
Eckert, Kelvin, "Dissertation, Cloning and Characterization of two glycosidases from the acidothermophile *Alicyclobacillus acidocaldarius* ATCC27009," Berlin, Dec. 18, 1971, 113 pages.
Edwards, C. P., and Aruffo, A., 1993, Current applications of COS cell based transient expression systems. Curr. Op. Biotechnology 4: 558-563.
Erlich, H.A., J Clin. Immunol., Nov. 1989; 9(6):437-47.
Garrote, G, H Dominguez, and JC Parajo, 2001, Manufacture of xylose-based fermentation media from corncobs by posthydrolysis of autohydrolysis liquors, Appl. Biochem. Biotechnol., 95:195-207.
Guateli, J. C. et al., 1990, PNAS. USA, 87: 1874-1878.
Hamelinck, CN, G van Hooijdonk, and APC Faaij, 2005, Ethanol from lignocellulosic biomass: techno-economic performance in short-, middle-, and long-term, Biomass Bioenergy, 28:384-410.
Huygen, K. et al., 1996, Nature Medicine, 2(8): 893-898.
International Preliminary Report on Patentability and Written Opinion of the International Searching Authority for PCT/US06/42566 dated Apr. 23, 2009 (7 pages).
Ito et al., "Purification and properties of acid stable xylanases from *Aspergillus kawachii*," Bioscience Biotechnology and Biochemistry 56 (4):547-550, Apr. 1992.
Jeffries, 1996, Curr. Op. in Biotech., 7:337-342.
Kievitis, T. et al., 1991, J. Virol. Methods, 35: 273-286.
Kohler, G. et al., 1975, Nature, 256(5517): 495497.
Kwoh, D. Y. et al., 1989, PNAS. USA, 86: 1173-1177.
Lavarack et al., "The acid hydrolysis of sugarcane begasse hemicellulose to produce xylose, arabinose, glucose and other products," Biomass and Bioenergy 23 (2002) 367-380.
Liu C, and CE Wyman, 2003, The effect of flow rate of compressed hot water on xylan, lignin, and total mass removal from corn stover, Ind. Eng. Chem. Res., 42:5409-5416.
Luckow, V. A., 1993, Baculovirus systems for the expression of human gene products. Curr. Op. Biotechnology 4: 564-572.
Lynd et al., 2002, Micro. and Mol. Biol. Rev., vol. 66, No. 3, p. 506-577.
Malherbe and Cloete, 2002, Re/View in Environmental Science and Bio/Technology, 1: 105-114.
Matthews, J. A. et al., 1988, Anal. Biochem., 169: 1-25.
Merrifield, R. D., 1966, J. Am. Chem. Soc., 88(21): 5051-5052.
Miele, E. A. et al., 1983, J. Mol. Biol., 171: 281-295.
Mielenz, 2001, Curr. Op. in Micro., 4:324-329.
Neddleman and Wunsch, J. Mol. Biol. 48: 443 (1970).
Olins, P. O., and Lee, S. C., 1993, Recent advances in heterologous gene expression in *E. coli*. Curr. Op. Biotechnology 4: 520-525.
PCT International Search Report and Written Opinion of the International Search Authority for PCT/US10/25521, dated Jul. 14, 2010, 12 pages.
Pearson and Lipman, Proc. Natl. Acad. Sci. (U.S.A.) 85: 2444 (1988).
Sanchez-Pescador, R., 1988, J. Clin. Microbiol., 26(10): 1934-1938.
Schäffer, C. et al., 2001, Prokaryotic glycosylation. Proteomics, 1: 248-261.
Shallom et al., "Microbial hemicellulases," Current Opinion in Microbiology, Current Biology Ltd, GB, vol. 6, No. 3, Jun. 1, 2003, pp. 219-228.
Supplemental European Search Report for EP 06 82 7231, dated Nov. 12, 2009, 6 pages.
Tsao, GT, MR Ladisch, and HR Bungay, 1987. Biomass Refining, In Advanced Biochemical Engineering, Wiley Interscience, N.Y., 79-101.
Upreti et al., 2003, Bacterial glycoproteins: Functions, biosynthesis and applications. Proteomics, 3: 363-379.

(56) References Cited

OTHER PUBLICATIONS

Urdea, M. S., 1988, Nucleic Acids Research, II: 4937-4957.
Vieille and Zeikus, 2001, Micro. and Mol. Biol. Rev., vol. 65, No. 1, p. 1-43.
Walker, G. T. et al., 1992, PNAS. USA, 89:392-396.
Walker, G. T. et al., 1992, NAR 20: 1691-1696.
Auerbach et al., "Lactate dehydrogenase from the hyperthermophilic bacterium *Thermotoga maritima*: the crystal structure at 2.1 Å resolution reveals strategies for intrinsic protein stabilization," Structure (London, England:1993) 1998; 6(6):769-81.
Iwata et al., "T and R states in the crystals of bacterial L-lactate dehydrogenase reveal the mechanism for allosteric control," Nature Structural Biology 1, 176-185 (1994).
Olive et al., "The Crystal and Molecular Structure of Yeast L-Lactate Dehydrogenase (Cytochrome b2)" Int. J. of Peptide Protein Res, 5:219-228 (1973).
Uchikoba et al., "Crystal Structure of Non-Allosteric L-Lactate Dehydrogenase From *Lactobacillus pentosus* at 2.3 Å Resolution: Specific Interactions at Subunit Interfaces," Proteins: Structure, Function, and Genetics, 46:206-214 (2002).
Bhatia et al., "Microbial beta-Glucosidases: Cloning, Properties, and Applications," Critical Reviews in Biotechnology, 22(4):375-407, Jan. 1, 2002.
Breves et al., "Genes Encoding Two Different beta-Glucosidases of *Thermoanaerobacter brockii* Are Clustered in a Common Operon," Applied and Environmental Microbiology, vol. 63, No. 10, Oct. 1997, pp. 3902-3910.
Database EMBL [Online]. Mar. 16, 2007. XP-002627757. Database accession No. ER073884, 1 page.
Database Geneseq [Online]. May 21, 1998. XP-002627734. Database accession No. AAW35004, 1 page.
Database UniProt [Online]. May 1, 1997. XP-002630045. Database accession No. P96090, 1 page.
Database UniProt [Online]. Oct. 1, 2001. XP-002627736. Database accession No. Q97UI4, 1 page.
Database UniProt [Online]. Jun. 26, 2007. XP-002627735. Database accession No. A5IKZ4, 1 page.
Database UniProt [Online]. Nov. 3, 2009. XP-002627733. Database accession No. C8WTP2, 1 page.
Extended Supplementary European Search Report for EP 09 70 3173, dated Apr. 20, 2011, 7 pages.
International Search Report of the International Searching Authority for PCT/US06/42566, dated Jul. 25, 2008.
PCT International Preliminary Report on Patentability of the International Search Authority for PCT/US09/32333, dated Aug. 3, 2010.
PCT International Preliminary Report on Patentability of the International Searching Authority for PCT/US09/00442, dated Jul. 27, 2010.
PCT International Preliminary Report on Patentability of the International Searching Authority for PCT/US09/34701, dated Aug. 24, 2010.
PCT International Preliminary Report on Patentability of the International Searching Authority for PCT/US09/35275, dated Aug. 31, 2010.
PCT International Preliminary Report on Patentability of the International Searching Authority for PCT/US09/35331, dated Aug. 31, 2010.
PCT International Preliminary Report on Patentability of the International Search Authority for PCT/US09/35307, mailed Jan. 25, 2011.
PCT International Search Report of the International Search Authority for PCT/US10/25521 Jul. 14, 2010.
Extended Supplementary European Search Report for EP 10 74 6882, dated Aug. 27, 2012, 9 pages.
Bork, Peer, "Powers and Pitfalls in Sequence Analysis: The 70% Hurdle," Genome Research, 2000, 10:398-400.
Bowie et al., "Deciphering the Message in Protein Sequences: Tolerance to Amino Acid Substitutions," Science, 1990, 247:1306-1310.
Lau et al., "PCR ligation mutagenesis in transformable *Streptococci*: application and efficiency," Journal of Microbiological Methods 49 (2002) 193-205.
Aden et al., "Lignocellulosic Biomass to Ethanol Process Design and Economics Utilizing Co-Current Dilute Acid Prehydrolysis and Enzymatic Hydrolysis for Corn Stover," NREL/TP-510-32438, National Renewable Energy Laboratory, Golden Colorado. Jun. 2002, pp. 1-88.
Avella et al., "A New Class of Biodegradable Materials: Poly-3-hydroxy-butyrate/Steam Exploded Straw Fiber Composites. I. Thermal and Impact Behaviour," Journal of Applied Polymer Science, vol. 49, 2091-2103 (1993).
Badger, P.C., "Ethanol from cellulose: A general review," In: J. Janick and A. Whipkey (eds.), Trands in new crops and new uses. ASHS Press, Alexandria, VA, 2002, pp. 17-21.
Bailey et al., "Interlaboratory testing of methods for assay of xylanase activity," Journal of Biotechnology, 23 (1992) 257-270.
Bergquist et al., "Molecular diversity of thermophilic cellulolytic and hemicellulolytic bacteria," FEMS Microbiology Ecology 28 (1999) 99-110.
Cowling, Ellis B., "Physical and Chemical Constrains in the Hydrolysis of Cellulose and Lignocellulosic Materials," Biotechnol. & Bioeng. Symposium No. 5, 163-181 (1975).
Crout et al., "Glycosidases and glycosyl transferases in glycoside and oligosaccharide synthesis," Current Opinion in Chemical Biology, Current Biology LTD, London, GB, vol. 2, No. 1, Feb. 1, 1998, pp. 98-111.
Dale, M. Clark, "Enzymatic simultaneous saccharification and fermentation (SSF) of biomass to ethanol in a pilot 130 liter multistage continuous reactor separator," Bio-Process Innovation, Inc., W. Lafayette, IN, 2005, 10 pages.
Database UniProt [Online]. Feb. 10, 2009. XP-000002659383. Database accession No. B7DT70, 1 page.
Ehrman, Tina, "Standard Method for Determination of Total Solids in Biomass," Chemical Analysis and Testing Task, Laboratory Analytical Procedure, Oct. 28, 1994, 242 total pages.
EMBL Submission CP001728, Sep. 2009. [Retrieved from the internet: URL:http://www.ebi.ac.uk/Tools/dbfetch/embifetch?style=html&id=CP001728&Submit=Go], 51 pages.
Extended Supplementary European Search Report for EP 09 82 3952, dated Sep. 20, 2011, 7 pages.
Fan et al., "The Nature of Lignocellulosics and Their Pretreatments for Enzymatic Hydrolysis," Advances in Biochemical Engineering/Biotechnology, 1982, vol. 23/1982, 157-187.
Flanagan, et al., "Development of gas phase bioreactors for the removal of nitrogen oxides from synthetic flue gas streams," Fuel 81 (2002) 1953-1961.
Fushinobu et al., "Crystallographic and mutational analyses of an extremely acidophilic and acid-stable xylanase: biased distribution of acidic residues and importance of Asp37 for catalysis at low pH," Protein Engineering vol. 11, No. 12, pp. 1121-1128, 1998.
Gessesse, Amare, "Purification and Properties of Two Thermostable Alkaline Xylanases from an Alkaliphilic *Bacillus* sp.," Applied and Environmental Microbiology, Sep. 1998, pp. 3533-3535.
Glenn et al., "Transformation of *Acidiphilium* by electroporation and conjugation," Can J Microbiol. May 1992;38 (5):387-93.
Goldstein et al., "The Hydrolysis of Cellulose with Superconcentrated Hydrochloric Acid," Biotechnology and Bioengineering Symp. No. 13, pp. 17-25 (1983).
Grassin et al., "Chapter 2.13, Fruit Juices," (T. Godfrey and S. West, eds.), Industrial Enzymology, 2nd Ed., pp. 227-264 (1996).
Grethlein, H. E., "Pretreatment for enhanced hydrolysis of cellulosic biomass," Biotechnol. Adv. 1984. 2:43-62.
Grethlein, Hans E., "Comparison of the Economics of Acid and Enzymatic Hydrolysis of Newsprint," Biotechnology and Bioengineering, vol. XX, pp. 503-525 (1978).
Hanselmann, K.W., "Lignochemicals," Experientia 38 (1982) pp. 176-189.
Houghton et al., "Fungal Upgrading of Wheat Straw for Straw-Thermoplastics Production," Applied Biochemistry and Biotechnology, vol. 113-116, 2004, pp. 71-93.

(56) References Cited

OTHER PUBLICATIONS

Keller et al., "Microbial Pretreatment of Biomass: Potential for Reducing the Severity of Thermochemical Biomass Pretreatment," Applied Biochemistry and Biotechnology, vol. 105-108, 2003.

Kenealy et al., "Rapid 2,2'-bicinchoninic-based xylanase assay compatible with high throughput screening," Biotechnology Letters 25: 1619-1623, 2003.

Knappert et al., "Partial Acid Hydrolysis of Cellulosic Materials as a Pretreatment for Enzymatic Hydrolysis," Biotechnology and Bioengineering, vol. XXII, pp. 1449-1463 (1980).

Kulkarni et al., "Molecular and biotechnological aspects of xylanases," FEMS Microbiology Reviews 23 (1999) 411-456.

Lauro et al., "Characterization of a β-glycosidase from the thermoacidophilic bacterium *Alicyclobacillus acidocaldarius*," Extremophiles (2006) 10:301-310.

Lee et al., "Oxygen Effects on Thermophilic Microbial Populations in Biofilters Treating Nitric Oxide Containing Off-Gas Streams," Environmental Progress, vol. 20, No. 3, Oct. 2001.

Lynd, Lee R., "Overview and Evaluation of Fuel Ethanol from Cellulosic Biomass: Technology, Economics, the Environment, and Policy," Annu. Rev. Energy Environ. 1996, 21:403-65.

Mackenzie et al., "Multiple Chromosomes in Bacteria: The Yin and Yang of trp Gene Localization in *Rhodobacter sphaeroides* 2.4.1," Genetics 153: 525-538 (Oct. 1999).

Manchenko, Gennady P., "Handbook of Detection of Enzymes on Electrophoretic Gels," CRC Press, Inc. 1994, pp. 220-240.

McCoy, Michael, "Chemical Makers Try Biotech Paths," Chemical Engineering News, Jun. 22, 1998, pp. 13-19.

Michel et al., "Specificity of the protein secretory apparatus: secretion of the heat-labile enterotoxin B subunit pentamers by different species of Gram bacteria," Gene 152 (1995) pp. 41-45.

Mosier et al., "Industrial Scale-Up of pH-Controlled Liquid Hot Water Pretreatment of Corn Fiber for Fuel Ethanol Production," Applied Biochemistry and Biotechnology, vol. 125, 2005, pp. 77-97.

Ng et al., 1981, Applied and Environmental Microbiology, 41(6):1337-1343.

Ohta et al., "Purification and Characterization of an Acidophilic Xylanase from *Aureobasidium pullulans* var. *melanigenum* and Sequence Analysis of the Encoding Gene," Journal of Bioscience and Bioengineering, vol. 92, No. 3, 262-270, 2001.

Ooshima et al., "Simultaneous saccharification and fermentation of cellulose: Effect of ethanol on enzymatic saccharification of cellulose," Department of Applied Chemistry, Faculty of Engineering, Osaka City University, Osaka 558, Japan, Jun. 5, 1984.

Pajunen et al., Microbiology (2005) 151, 1209-1218.

Patel et al., (2006), "Medium and long-term opportunities and risks of the biotechnological production of bulk chemicals from renewable resources: The potential of white biotechnology". The BREW Project. Final Report prepared under the European Commission's GROWTH Programme (DG Research), (publica.fraunhofer.de/eprints/N-48834.pdf).

PCT International Search Report and Written Opinion of the International Searching Authority for PCT/US10/51095, dated Dec. 2, 2010, 11 pages.

PCT International Search Report and Written Opinion of the International Search Authority for PCT/US11/34852, dated Oct. 21, 2011, 12 pages.

Perlack et al., "Biomass as Feedstock for a Bioenergy and Bioproducts Industry: The Technical Feasibility of a Billion-Ton Annual Supply," USDA and DOE, Apr. 2005, 78 pages.

Peyton et al., "Biotransformation of Toxic Organic and Inorganic Contaminants by Halophilic Bacteria," Halophilic Microorganisms, Antionio Ventosa (Ed.), Springer, 2004, pp. 315-331.

Ragauskas et al., "The Path Forward for Biofuels and Biomaterials," Science, Jan. 27, 2006, vol. 311, pp. 484-4589.

Ramos et al., "Biomechanical and Biochemical Pulping of Sugarcane Bagasse with *Ceriporiopsis subvermispora* Fungal and Xylanase Pretreatments," J. Agric. Food Chem. 2001, 49, 1180-1186.

Saeman et al., "Quantitative Saccharification of Wood and Cellulose," Industrial and Engineering Chemistry, Jan. 1945, vol. 17, No. 1, pp. 35-37.

Saha et al., "Dilute Acid Pretreatment, Enzymatic Saccharification, and Fermentation of Rice Hulls to Ethanol," Biotechnol. Prog. 2005, 21, 816-822.

Sa-Pereira et al., "Rapid production of thermostable cellulose-free xylanase by a strain of *Bacillus subtilis* and its properties," Enzyme and Microbial Technology, 30 (2002) 924-933.

Schell et al., "Dilute-Sulfuric Acid Pretreatment of Corn Stover in Pilot-Scale Reactor," Applied Biochemistry and Biotechnology,' vol. 105-108, 2003, pp. 69-85.

Schwarz, Wolfgang H., "A list of cellulolytic bacteria," Technische Universitat Munchen, Apr. 24, 2003, 8 pages.

Simpson et al., "An extremely Thermostable xylanase from the thermophilic eubacterium *Thermotoga*," Biochem. J. (1991) 277, 413-417.

Smook, G.A., "Handbook for Pulp & Paper Technologists," Tappi Pr; 2nd Ed. (Jun. 1992) pp. 65-88.

Subramaniyan et al., "Cellulase-free xylanases from *Bacillus* and other microorganisms," FEMS Microbiology Letters 183 (2000) 1-7.

Sunna et al., "Glycosyl hydrolases from hyperthermophiles," Extremophiles (1997) 12-13.

Techapun et al., "Production of a cellulose-free xylanase from agricultural waste materials by a thermotolerant *Streptomyces* sp.," Biotechnology Letters 23: 1685-1689, 2001.

Thompson et al., "Comparison of Pretreatment Methods on the Basis of Available Surface Area," Bioresource Technology 39 (1992) 155-163.

Thompson et al., "In Vitro Degradation of Natural Insoluble Lignin in Aqueous Media by the Extracellular Peroxidases of *Phanerochaete chrysosporium*," 1998 John Wiley & Sons, Inc. pp. 704-717.

Thompson et al., "Measurement of fumonsins in corn with a fiber-optic fluoroimmunosensor," SPIE vol. 2980, (2010) pp. 532-538.

Thompson et al., "Preliminary Investigation of Fungal Bioprocessing of Wheat Straw for Production of Straw-Thermoplastic Composites," Applied Biochemistry and Biotechnology, vol. 105-108, 2003, pp. 423-436.

Thompson et al., "Purification and Characterization of a Novel Thermo-Alkali-Stable Catalase from *Thermus brockianus*," Biotechnol. Prog. 2003, 19, 1292-1299.

Thompson et al., "Thermoacidophilic Cellulases and Hemicellulases from *Alicyclobacillus acidocaldarius*," Idaho National Laboratory, 2006, 1 page.

Thompson, et al., "Chapter 31: Changes in the Rate of Enzymatic Hydrolysis and Surface Area Available to Cellulase with Pretreatment Methods," Biotechnology in Pulp and Paper Manufacture: Applications and Fundamental Investigations. Proceedings of the Fourth International Conference on Biotechnology in the Pulp and Paper Industry (ICBPPI), May 16-19, 1989,Raleigh, NC and Myrtle Beach, SC, USA, Kirk, T.K. and Chang, H.M. (eds.). Butterworth-Heinemann, Boston, 1990, pp. 329-338.

Tsao, G.T., "Bacterial Hydrolysis: A Review," Anaerobic Digestion and Carbohydrate Hydrolysis of Waste, Ferrero et al. (eds.), Elsevier Applied Science Publishers, London, 1984, pp. 83-99.

Turner et al., "Potential and utilization of thermophiles and thermostable enzymes in biorefining," Microbial Cell Factories, Biomed Central, London, NL, vol. 6, No. 1, Mar. 15, 2007, p. 9.

Uhl et al., "The first description of an archaeal hemicellulase: the xylanase from *Thermococcus zilligii* strain AN1," Extremophiles (1999) 3:263-267.

Viikari et al., "Xylanases in bleaching: From an idea to the industry," FEMS Microbiology Reviews 13 (1994) 335-350.

Walseth, Curtis S., Occurrence of Cellulases in Enzyme Preparations from Microorganisms, TAPPI vol. 35, No. 5, May 1952, pp. 228-233.

Ward et al., "Characterization of a new bacteriophage which infects bacteria of the genus *Acidiphilium*," Journal of General Virology (1993) 74: 2419-2425.

Ward et al., "Electrotransformation of Acidophilic, Heterotrophic, Gram-negative Bacteria," Electrotransformation of Bacteria, Natalie Eynard, Justin Teissie (eds.), Springer (2000) pp. 94-103.

Wright et al., "Ethanol from Biomass by Enzymatic Hydrolysis," Chemical Engineering Progress, Aug. 1988, pp. 62-74.

(56) References Cited

OTHER PUBLICATIONS

Yuan et al., Expression of acidophilic alpha-amylase from *Alicyclobacillus acidocaldarius*, Sheng Wu Gong Cheng Xue Bao, Jan. 2005, 21(1):78-83. Abstract only.

Database UniProt [Online]. Feb. 10, 2009. XP-002698982. Database accession No. B7DRM6, 1 page.

Extended Supplementary European Search Report for EP 09 75 5308, dated Jun. 18, 2013, 3 pages.

Extended Supplementary European Search Report for EP 09 70 9191, dated Mar. 29, 2012, 6 pages.

Database UniProt [Online]. Feb. 10, 2009. XP-002695727. Database accession No. B7DUZ1, 1 page.

Extended Supplementary European Search Report for EP 09 74 3132, dated Apr. 19, 2013, 4 pages.

Database Uniprot [Online] Nov. 3, 2009. Database accession No. C8WVZ2, 2 pages.

Database UniProt [Online]. Feb. 10, 2009. XP-002674095. Database accession No. B7DM51, 1 page.

Extended Supplementary European Search Report for EP 09 75 5307, dated Apr. 18, 2012, 4 pages.

GenBank: AJ252161.1 *Alicyclobacillus acidocaldarius* maltose/maltodextrine transport gene region(malEFGR genese, cdaA gene and glcA gene), NCBI, Hulsmann, A. http://www.ncbi.nlm.nih.gov/nuccore/AJ252161 (Jan. 6, 2000).

Lin et al., "Purification, Characterization, and Gene Cloning of Thermopsin, a Thermostable Acid Protease from *Sulfolobus acidocaldarius*," The Journal of Biological Chemistry, 1990, vol. 265, No. 3, pp. 1490-1495.

FIG. 1A

```
ref|YP_359514.1|    ---DNFEALLQESRIFEPPAEFKEKAKVADLS----LYEWAERDFLGFWADAAKDIEWFL
ref|YP_516748.1|    MEEKNLEALLEEDRQFIPSEEFHKNALIQSAD----IYEQG--QSLGFWEEQAKQLSWLS
ref|YP_074710.1|    MDSKQFAALLNEDRRFPPPAEFAARANVADES----LYEQAARDREGFWAAQAERLHWFR
ref|YP_144514.1|    -----LESVLKEERVFYPSEEFRKQAHIKSEEEYQRLYEESVRDPEGFWGRVASELHWFE
ref|YP_643635.1|    -------------RTYDPPEEFASRANVRDPG----VYEEAARDYEGFWAERARKLHWFR
RAAC00079           MTPNDLDALLRETRTFAPSEEFRRQANYKDES----IYEEAARDPEGYWAKQAEHITWFH
                             *  :  *.  **   .*    .       :**  .  :  *:*    *  : *:

ref|YP_359514.1|    PFEKVLDDSDAPFYRWYTGGKLNVSYNCVDRHTKSFRRNKAALIFEG-EPGDSKILTYQE
ref|YP_516748.1|    PWEKTLEWN-PPFAQWFVGGKLNASANCLDRHLQDWHRNKAAIIFEG-ENGDSQVLTYQD
ref|YP_074710.1|    RWDKVLEWN-PPFAQWFLGGKLNVAYNCLDRHLQTHTRTKAAIIWEG-EPGDERVLTYLD
ref|YP_144514.1|    PWRKVLEGD-LPHPKWFVGGKTNLSYNALDRHVKTWRRNKAAIVWEG-EPGEERVLTYHD
ref|YP_643635.1|    EWDEVLRWD-PPEAQWFVGGKINASYNCLDYQVQQGRGDKRAIIWEGDEPGENRTLTYSE
RAAC00079           EFESVCRWD-PPHAQWFIGGKLNAAYNCVDRHTLTHRKNKAAIIWEG-EPGDSRVLTYDM
                     :  ..   . *  :*: ***  *  :  *.:*  :         * *:::** * *:..: *** ref|YP_359514.1|    LYREVNKFANVLKKLGVQKGDRVTIYMPMIPEAVIAMLACTRIGAPHSVVFGGFSSQALK
ref|YP_516748.1|    LHREVSKFANVLKANGVNKGDRVTIYLPMIPEAVISMLACARIGAPHSVVFGGFSSEALR
ref|YP_074710.1|    LHREVCRFANVLRQMGVGKGDRVTIYLPMIPEAAVAMLACTRIGAIHSVVFGGFSAESLR
ref|YP_144514.1|    LWREVQRFANVLKRLGVKKGDRVTIYLPMIPEAAIAMLACTRIGAVHSVVFGGFSAGALA
ref|YP_643635.1|    LKAEVEKFANVLKGLGVRKGDAVSIYLPMIPELPIAMLACARIGAPHSVVFGAFSAQSLR
RAAC00079           LRREVDKAAHMLTQLGVKKGDRVTIYLPMVPELPIAMLACAKIGAMHSVVFGGFSAQALK
                    *  **  : *::*    *  *:::   :::* ****.: :* ref|YP_359514.1|    DRIDDAKAKLLITADGGYRRGSIVELKKNADAALEGETTIEKVVVVKRTGQ----EVPMT
ref|YP_516748.1|    DRVIDAQAKAVITSDGSFRRGNTIPLKDNTDIALDGVDCVEHVFVIQRTKQT--VQ--MK
ref|YP_074710.1|    DRINDSRSKVVVTADGGWRRGNIIRMKQIVNEAVVDCASVEKVIVVKRIGHESLVEHGWH
ref|YP_144514.1|    DRIKDAEAKVLITADGGFRRGGIVPLKQNADEALKDATSVEHVVVVRRTGE----EVPWT
ref|YP_643635.1|    DRINDCEAKVLVTADSGPRGGKRTPLKANADEALEDTPSIEKVVVVRRTGD----EVNMV
RAAC00079           DRILDAGSKLLITADGGWRRGKVIPLKQNADEAVVGTP-IEKVVVVQRIGEA--AQAAMD
                    **: *. :*   ::*:*..  * *     :*   .:   *: .      :*:*.*::*    .   :

ref|YP_359514.1|    EGRDYWYHELMADAALYCEP-EQCDAEDMLFILYSSGTTGKPKGIQHTTGGYLVGVHTTF
ref|YP_516748.1|    EERDLWYHEEMAKA-SPVCPAEPMDAEDMLFILYTSGTTGKPKGVVHTTGGYMVGVSTTH
ref|YP_074710.1|    PGRDHWYHTLMRNAPVT-CPVEEMDAEDPLFILYTSGSTGKPKGVLHTTGGYLTQVAATT
ref|YP_144514.1|    PGRDHWWHELMEAAPDRCDP-EPMEAEEPLFILYTSGSTGKPKGVLHTTGGYMTYVYYTT
ref|YP_643635.1|    EGRDLWWHELMREAEPE-CPAEEMDSEDILYILYSSGSTGKPKGIVHTTGGYLTHVNTTT
RAAC00079           PARDVWWHEAMQSAPTKPFPAEPMDAEDYLFLLYTSGTTGKPKGIVHSTGGYLVGVNTSM
                     * **  *:*  *   *          *  ::*: *::**:**:******:  *:****:. *   :

ref|YP_359514.1|    KYIFDYREEDIYWCTADIGWITGHSYIVYGPLSNGATVVLYEGAPDWPQKDRFWEIIEKY
ref|YP_516748.1|    RWVFDLKEEDVYWCTADVGWITGHSYIVYGPLANGATVLMYEGSPDYPNRDRFWEIVEKY
ref|YP_074710.1|    KYVFDLKDEDVYWCSADIGWITGHSYVIYGPLANGATTLMYEGAPDYPDRGRIWEIIQKY
ref|YP_144514.1|    KLVFDLKDEDVYWCTADVGWITGHSYVVYGPLLNGATTVMYEGAPNWPEPDRFWRIVDKY
ref|YP_643635.1|    DWVFDLKEDDVYWCTADIGWVTGHSYIVYGPLSNGATALMFEGTPSYPANDRWWDIIERH
RAAC00079           RTVFDLKDEDVFFCTADIGWITGHTYIVYGPLSAGATVVMYEGSPDYPDRDRYWAIVEKY
                      :**  :::*::*:**.***:::**** ***.:::**:*.:*    .* * *::::

ref|YP_359514.1|    RVNILYTAPTAIRTFMRWGEKWPKGRDLSSLRLLGTVGEPINPEAWIWYHEHIGGGRCPI
ref|YP_516748.1|    KVTILYTAPTAIRTFMKWGPQYPQSRDLSSLRLLGSVGEPINPEAWMWYYKYIGGERCPI
ref|YP_074710.1|    RVNIFYTAPTLIRSFMRWGEGWPSKYDLSSLRLLGTVGEPINPEAWMWYHKHIGGERCPI
ref|YP_144514.1|    GVTVFYTAPTAIRSFMKWGEGWPGKHRLDSLRLLGTVGEPINPEAWLWYYHVIGKGRCPI
ref|YP_643635.1|    GVTILYTAPTAIRAFMKQGPGPIEKHDLSSLRLLGSVGEPINPRAWEWYHEHVGGGRCPV
RAAC00079           GATILYTAPTSIRMFMKWGPQYVEKHDLSTLRLLGSVGEPINPEAWMWYHKYVGQERCPI
                    ...::***** ** **: *      *.:*****:******.** **:. :*   ***:
```

FIG. 1B

```
ref|YP_359514.1|    VDTWWQTETGMIMITPLPGVIPTKPGSATKPFPGVEADVVNDKGEPVP-PGQGGYLVLKK
ref|YP_516748.1|    VDTWWQTETGMIMMTPLPGITSLKPGSCTVPFPGVRIEVVDSAGHPVP-KGGGGYLAIKE
ref|YP_074710.1|    VDTWWQTETGAIMATPLPGVVHTKPGSTTRPFPGIEMAVVNEEGQEVP-PGAGGYLVVKS
ref|YP_144514.1|    VDTWWQTETGGIMITTLPGAHAMKPGHAGKPFFGVVPEILDGEHRPVENPDEGGHLCITR
ref|YP_643635.1|    VDTWWQTETGGIMISPLPGITRTKPGSATFPLPGIFAGIYDEEGNEIE-GPGVGNLVIKR
RAAC00079           VDTWWQTETGCAMIAPLPGIITTKPGSATKPVPGISVDILDDDGNPVP-PGHGGNLVITK
                    **********  *  .***     ***     *. *:    : :    . :    * * :.

ref|YP_359514.1|    PWPAMLRTLYGDPERYKNTYWSKFPG-WYFTGDGAKKDEDGYFWILGRVDDVINVSGHRI
ref|YP_516748.1|    PWPAMLRNIYGDPARFERTYFGNWPG-VYFPGDGAKWDKDGYFWILGRVDDVINVSGHRI
ref|YP_074710.1|    PWPSMLRTVWGDPDRYVSTYFGRFGHQVYFTGDGAKRDEDGYYWIIGRVDDVINVSGHRI
ref|YP_144514.1|    PWPSMLRTVWGDPERFLQQYFSQHPG-VYFSGDGAKRDKDGYYMILGRVDDVLNVAGHRL
ref|YP_643635.1|    PWPGMLRTLYKDPERFRETYWQKYGD-VYFSGDGARRDEDGYFWVTGRVDDVINVSGHRI
RAAC00079           PWPSMLRTVWGDDERFRKTYFEKFEG-IYLPGDGAYRDQDGYYWIVGRLDDVINVSGHRI
                    *** .***  .::  *  *:    *: .       *:.****  *:***:  :**:***:***:

ref|YP_359514.1|    GTMEVESALVEHPLVAEAAVIGKSHEVKGQAIAAFVTLKEGVEGTPELVQELKQFVAQKI
ref|YP_516748.1|    GTMEVESALVDHPSVAEAAVIGKNHEVKGQALACFVTLKEGIEITPDLEDELKKHVAKKI
ref|YP_074710.1|    GTMEVESALVDHPLVAEAAVIGRSHAVKGQAITAFVTLKEGRRGTPDLVDELKQHVVTKI
ref|YP_144514.1|    GTMEIESALVAHPAVAEAAVVGRPDPVKGEAIVAFVTLKEGHTPSDALKEELRAHVAKVI
ref|YP_643635.1|    STAEVESALVAHPAVAEAAVIGRYDEDTGQAIVAYVILEGGREGNDELAQELRQQVRKVI
RAAC00079           GTAEVESALVAHPAVAEAAVIGRAHEVKGQAITAFVILKEGHTGSDDLVSELKQFVVEQI
                     .*  *:****    ******:*:       .:*:...:*  *: *      . *  .**:  *   * ref|YP_359514.1|    GALARPDDIFFTAELPKTRSGKIMRRLLRDIAEG--RALGDTTTLTDPAVINKIKEQYKD
ref|YP_516748.1|    GALARPDDIFFTAELPKTRSGKIMRRLLRDIAEG--RAIGDTTTLADASVVNTLKANYQE
ref|YP_074710.1|    GALARPEEIYFAADLPKTRSGKIMRRLLRDIAEG--RALGDTTTLADPNVVAQLRQQYES
ref|YP_144514.1|    GPIARPDEIRFTDALPKTRSGKIMRRLLRQIAAGEKEIKGDTSTLEDRSVVERLK-----
ref|YP_643635.1|    GAHARPQEIIFTPDLPKTRSGKIMRRILRSLSEG-RDDLGDTTTLADPGVVESLKEQ---
RAAC00079           GAMARPEEIIFTADLPKTRSGKIMRRLLRDIAEG-R-VVGDTTTLADPAVVEQLKSQYKD
                    *. ***::* *:  *************:**.:: *       ***:**  *  *:   ::

ref|YP_359514.1|    E-
ref|YP_516748.1|    --
ref|YP_074710.1|    QE
ref|YP_144514.1|    --
ref|YP_643635.1|    --
RAAC00079           QE
```

FIG. 2

```
ref|NP_693902.1|      ------------------------------------------------------------
ref|ZP_01725542.1|    ------------------------------------------------------------
ref|YP_521150.1|      ------------------------------------------------------------
ref|ZP_01666741.1|    ------------------------------------------------------------
gb|ABE97159.1|        ------------------------------------------------------------
RAAC00455             MRRTASTDPRRPQGLARTKFTSINKRRNRLMQLDMVKAIYDIAVALLLGLAAVGSGVGDG ref|NP_693902.1|      ----KTVEGIARQPELRGALQGTMFIGVALVEAIPIIAAVIAFMVM------
ref|ZP_01725542.1|    ----KTVEGIARQPEARGVLQTTMFIGVALVEALPIIAVVVAFIVM------
ref|YP_521150.1|      ----KTVEGIARQPEAKGALQSTMFIGVGLIEALPLLTWVLALLLMFTK---
ref|ZP_01666741.1|    ----KAIEGMARQPEAKGTILVNMLISVGLIESIPIIAAVIAIVLVF-----
gb|ABE97159.1|        ----RYLSGITRQPEAASQLLTSMFIGIALVEALPIIAVALGIIKLFSIGS-
RAAC00455             MVMSKYVEGVARQPEARGSIFGSALLGVALVEAFPVIALAFGIIILFTKGAF
                        : :.*::****   . :   . ::.:.*:*::*::: ...:: :
```

FIG. 3A

```
ref|YP_001127398.1|      ---------------------------------LPQQDPQVFATIEQERKRQHAKIELIA
ref|YP_149222.1|         ---------------------------------LPQQDPQVFAAIEQERKRQHAKIELIA
ref|NP_244632.1|         ---------------------------------LQSKDPKVFEAVQQELGRQRDKIELIA
ref|ZP_00538452.1|       ---------------------------------TYLKQQDEELFSAMRKELKRQRDNIELIA
ref|YP_361350.1|         ---------------------------------LNLRLKDVDPEIFEAMEKELSRQREKIELIA
RAAC00461                MCAPCSNRKMNVNRGVLSHAALDERSCAGLTTLLQQVDPDVASAMQAELRRQQRNIELIA
                                                          * . * .:  ::. *  : :*** ref|YP_001127398.1|      SENFVSRAVMEAQGSVMTNKYAEGYPGRRYYGGCEYVDVVEDLARERAKQLFGAEHANVQ
ref|YP_149222.1|         SENFVSRAVMEAQGSVLTNKYAEGYPGRRYYGGCEYVDIVEDLARERAKQLFGAEHVNVQ
ref|NP_244632.1|         SENFVSEAVMEAQSSVLTNKYAEGYPGRRYYGGCEYVDIVEDLARDRAKEIFGGEHVNVQ
ref|ZP_00538452.1|       SENFVSQAVMEAQGSVLTNKYAEGYPGRRYYGGCEFVDLAENLARDRAKAIFGAEHVNVQ
ref|YP_361350.1|         SENFVSRAVMEAMGSHLTNKYAEGLPGKRYYGGCEYVDVVENLARERAKKLFGAEHVNVQ
RAAC00461                SENFVSEAVLEALGSVLTNKYAEGYPGRRYYGGCEYVDVVERIAIDRVKELFGAEYANVQ
                         ****.:**  .* :***** :*****.:..*  :* :*.*  :**.*:.*** ref|YP_001127398.1|      PHSGAQANMAVYFTVLKPGDTVLGMNLSHGGHLTHGSPVNFSGVQYNFVEYGVDPETHVI
ref|YP_149222.1|         PHSGAQANMAVYFTVLEHGDTVLGMNLSHGGHLTHGSPVNFSGIQYNFVEYGVDPETHVI
ref|NP_244632.1|         PHSGAQANMAVYFTILEHGDTVLGMNLSHGGHLTHGSPVNFSGIQYNFVEYGVDKESQRI
ref|ZP_00538452.1|       PHSGAQANMAVYFTILNQGDTVLGMNLSHGGHLTHGSPVNFSGVQYNFVEYGVDPETEMI
ref|YP_361350.1|         PHSGAQANMAAYMAFLEPGDTVLGMNLAHGGHLTHGSPVNFSGKLYNFVSYGVEPDTEKI
RAAC00461                PHSGSQANMTVYFSVLKPGDTVLGMNLAHGGHLTHGSPVNFSGQLYKFVSYGVHPETHLI
                         **:**:.*.::.*: *******.********* :.***. ::. * ref|YP_001127398.1|      DYDDVREKARLHRPKLIVAGASAYPRVIDFAKFREIADEVGAYLMVDMAHIAGLVAAGLH
ref|YP_149222.1|         DYDDVREKARLHRPKLIVAGASAYPRIIDFAKFREIADEVGAYLMVDMAHIAGLVAAGVH
ref|NP_244632.1|         DYEEVRRLAKEHQPKMIVAGASAYPREIDFAKFREIADEVGAYLMVDMAHIAGLVAAGLH
ref|ZP_00538452.1|       DYDVVAKLAEEHKPKLIVAGASAYPRVIDFKRFREIADSVGAYLMVDMAHIAGLVAAGLH
ref|YP_361350.1|         NYEKVFELAYKHKPKMIVAGASAYPRVIDFKHLKEIADEVGAYLMVDMAHIAGLVAAGLH
RAAC00461                DYDEVLKVAKEHRPKMIVAGASAYPRVIDFKRMREIADEVGAYLMVDMAHIAGLIAAGLH
                         :*:  *  . *  *::*****  *   :::**.*************:*.* ref|YP_001127398.1|      PNPVPYAHFVTTTTHKTLRGPRGGMILCQEQFAKQIDKSIFPGIQGGPLMHVIAAKAVAL
ref|YP_149222.1|         PNPVPYAHFVTTTTHKTLRGPRGGMILCQEQFAKQIDKAIFPGIQGGPLMHVIAAKAVAL
ref|NP_244632.1|         QNPVPYAHFVTTTTHKTLRGPRGGMIICNEEFAKQIDKSIFPGIQGGPLMHVIAAKAVAF
ref|ZP_00538452.1|       PNPVEHAHFVTTTTHKTLRGPRGGMILCKEEHAKAIDKSIFPGIQGGPLMHVIAAKAVAF
ref|YP_361350.1|         PSPIPYADVVTTTTHKTLRGPRGGVIFCKAEHAAKIDKTVFPGVQGGPLMHVIAAKAVAF
RAAC00461                PSPVPYAHFVTSTTHKTLRGPRGGFILCQKDVAKLIDKTNFPGVQGGPLMHVIAAKAVAF
                         .*: ::..**:*********** .*:*:  : *   ***: ***:***************:

ref|YP_001127398.1|      GEALQDDFKVYAKRIIDNAQRLAAALQKEGFTLVSGGTDNHLLLVDLRPQQLTGKTAEKV
ref|YP_149222.1|         GEALQDDFKVYAKRVVENAKRLAAALQNEGFTLISGGTDNHLLLVDLRPQQLTGKTAEKV
ref|NP_244632.1|         GEALQPEFKSYGEAIIRNAKRLGEKLTSEGIDLVSGGTDNHLLLLDLRSLGLTGKVAEKA
ref|ZP_00538452.1|       AEALAPEFKDYIEQVVANAKVLGEELTARGLRIVSGGTDNHLLLVDLQPLGITGKLAEHA
ref|YP_361350.1|         KEALSPEFREYQQQVVNNAKALAEELKKQGLRLVSGGTDNHLMLVDVRPVGLTGKRAEQL
RAAC00461                GEALKPEFKAYQEQIVKNAKALAEALKGYGFRLVSGGTDNHLMLIDVRSAGLTGKEAERR
                         ***  :*:  *  :   :: **:  *.    *: ::********:*:*:: .  :*** **:

ref|YP_001127398.1|      LDEVGITVNKNTIPYDPESPFVTSGIRIGTAAVTTRGFGLEEMDEIASLIGLVLKNIDNE
ref|YP_149222.1|         LDEVGITVNKNTIPYDPESPFVTSGIRIGTAAVTTRGFGLEEMDEIAAIIGLVLKNVGSE
ref|NP_244632.1|         LDDVGITTNKNTIPFDPESPFVTSGIRIGTAAVTSRGLDEEAMDEIGATIALTLKNVDNE
ref|ZP_00538452.1|       LDEAGITVNKNTIPFDPASPFVTSGIRIGTAAMTSRGFKEAEMKQIAELIELVLKNPEDQ
ref|YP_361350.1|         LDEIGVTVNKNAIPYDPESPNVTSGIRIGTPAVTTRGMKEGEMAEIAEIIALVLKNPENE
RAAC00461                LDEIGITVNKNAIPFDPESPMVTSGIRVGTPAATSRGMDEGAMQEIAEIFKLVLLGDFSD
                         **: *:*.***:**:** ** ******.** * *:: *:**:       * :*. :  *.*  .:
```

FIG. 3B

```
ref|YP_001127398.1|      QALEEARQRVVALTEKFPLY-------
ref|YP_149222.1|         QALEEARQRVAALTEKFPLY-------
ref|NP_244632.1|         EKMNEARERVDALTAKFPMYPNL----
ref|ZP_00538452.1|       ETLTSAHKQVLALTGRFPLYP------
ref|YP_361350.1|         DKHREAARKVRDLLNRFPLYDKLPY--
RAAC00461                EVKREARARVDSLTDRFPLYPTLSYVE
                         :    .*   :*   *   :**:*
```

FIG. 4

```
ref|ZP_01666099.1|     ----------YEFDGGIGIITINRPKALNALNGATMRELNELLDVIAQDPSVKVVIITGS
ref|YP_360429.1|       ----------FEKKDQVGIITINRPQVLNALNSEVLEELDSLLDKIAEDESITVVILTGA
ref|NP_905294.1|       -------------KDGITTLTINKPETLNALSSEVLSELKSAIAVIATEK-PRVLIITGS
ref|YP_754604.1|       -------------EEKLAVLYINRPKAMNALNKDTLLEIKDAVTAVNDDPAVELLIITGS
ref|YP_384529.1|       ----------RHDDAIAVVSLARPESRNVLSRDLVLGLLSTFTSLKDDGRVKGIVVTGE
RAAC00481              MRNLTETFTTYRVEDHVAVLTLNRPQALNALSR-EVLSEIGAHLAMLDLKDVRVLVIRGE
                                 .  :  : ::*:  *.*.   :              :    ::: * ref|ZP_01666099.1|     GEKAFVAGADITEMQSMSAIEGRNWGKLGQAVFDKLENLPQPVIAAVNGFALGGGCELAM
ref|YP_360429.1|       GEKSFVAGADISQMRNFTPRQARYFAKLGQKVLSKLERIPQPVIAAVNGFALGGGCEIAM
ref|NP_905294.1|       G-KAFVAGADIAEMQHLSAAEGKAFGGLGAEVFRRIEELPFPVIAAINGFALGGGCELAM
ref|YP_754604.1|       GDKSFVAGADIAFMQNLSAMEAREFGALGQKVFRLIEAMEKPVIAAVNGFALGGGCELAM
ref|YP_384529.1|       G-KSFCAGADISEMARMSPAEASSFAELGQRLMFAVERVGKPVVAAVNGHAFGGGLELAL
RAAC00481              G-RVFCAGADIGQMQHMSAVEAESMARLGQRVFQAIEQLPIPVIALIHGGAFGGGLELAL
                       *  : * *****  *   ::. :.    .  **   ::   :* :  **:*  ::* *:*:

ref|ZP_01666099.1|     ACDIRIASDKAKFGQPEVTLGITPGFAGTQRLPRLVGKGRAKELLFTGDMIDAAEAYRIG
ref|YP_360429.1|       ACDFRIASTKAKFGQPEVGLGVTAGFGGTQRLPRLVGKGMAAELLYTGEMIDAQEALRIG
ref|NP_905294.1|       ACDIRIASAKAKFGQPEVGLGITPGFSGTQRLPRLVAPGIAKELIYTGRIIDAEEALRIG
ref|YP_754604.1|       CCDFRIAASNAKFGQPEVGLGITPGFGGTQRLPRLVGPGMAKQLLYTADVINADEAFRIG
ref|YP_384529.1|       ACDFIVAAESAVFAAPEVLLGVMPGFGGTQRLPRLIGKSRAKEMIFTGERINAAKAHSIG
RAAC00481              ACDFRIAAAGAVVGLPEVTLGVNPSFGGTYRLPRAIGFARALSMMLLGERIPVEKALEYG
                       .**: :*:    *   * : ..*. **  :.  *  .::   .   .:*   * ref|ZP_01666099.1|     LVNKVVPPEELMAAAKAMAQKIMSRAPMAVQLCKAAVNEGMDMDLQSAVAYEAEVFGLCF
ref|YP_360429.1|       LVNRVVEPEELMPTALEIAQKIAAKAKLAVFYSKAALNEGLNMDLERALAYEAEMFALCF
ref|NP_905294.1|       LVNRVTTPEELLPATMETAQLIASRSASAVSASKEAINRGTEMHIAEGIALEQNLFGLCF
ref|YP_754604.1|       LVNKVVQPEELLPEVKKIAGRILSKGQLAVRLSKAAANEGMQTDIDRAMSIEADAFGLCF
ref|YP_384529.1|       LVNRVVSDERLLAETVSLVKNICNRGLLSLRVAKEVIDAGAGIDLATACLMERDAFALCF
RAAC00481              LVNEVVAPDELEARGMDLARKLASQSSAAMAAIKRSAHHGFGQDPARAQAYEAAQFGLCF
                       ***.*.   ::.*      .  : :. ::    *  .*    .  . *    *.*** ref|ZP_01666099.1|     ATADQKEGMAAFVEKRKANF---
ref|YP_360429.1|       TTSDQKEGMDAFLNKRKPEF---
ref|NP_905294.1|       ATADQKEGMAAFLEKRKPAF---
ref|YP_754604.1|       ATQDQKEGMTAFLEKRKANF---
ref|YP_384529.1|       STDDQKEGMRAFMEKREPRF---
RAAC00481              ASGDAHEGMAAFKEKRQARFHED
                       :: * :*** **  :**:. *
```

FIG. 5

```
ref|YP_146903.1|         ---------RRDLHQIPELGFQEFKTQQYLLRYIQSLPQERLQVRTWKTGIFVKVNGTSP
ref|YP_001125035.1|      ---------RRDLHKIPELGFQEFKTQQYLLNYIQSLPQERLDVRTWKTGIFVKVSGTAP
ref|YP_001646604.1|      --------QVRRDLHKIPEIGFKEWKTQQYILDYIGTLPNEYLEVKTWKTGVIVKVNGKNP
ref|YP_001375911.1|      --------QIRRDLHQIPELGFQEWKTQQYILNYIETLPNEHIEVKTWKTGVIVKVKGKNP
ref|ZP_01696300.1|       -METNLIAIRRDLHRIPELGYKEHKTQRYILDFISRLPKGHLEVKTWKTGVLVKVKGTCP
RAAC00529                MMEWDVYEARRALHQIPEPGFREFETQKLVLSYLQALPQEHLEIRTWETGVIALVKGHSP
                                   :*** *::* :**: :* ::   :   ::::::**:.  *.*  * ref|YP_146903.1|         RKTIGYRADMDGLPIREETGLPYRSKHEGRMHACGHDVHMSIALGVLTHFAHHPLKDDLL
ref|YP_001125035.1|      RKTIGYRADIDGLPISEETGLPYRSEHAGQMHACGHDVHMSIALGVLTHFAHNPIRDDLL
ref|YP_001646604.1|      EKIIGYRADIDGLPITEETGYEYSSVHEGMMHACGHDLHATIGLGLLTAAVSERIDDDLV
ref|YP_001375911.1|      VKTIGYRADMDGLPIVEETGYEFASTHEGMMHACGHDFHTTIGLGLLTATVNDRIDDDLV
ref|ZP_01696300.1|       EKKIGYRTDIDGLPIKEETGFPFQSEHEGNMHACGHDFHMTIALGILSHFASRPVKDDLI
RAAC00529                KRRVGWRADMDGLPVAEETGVPYASRHPGMMHACGHDVHMAVALGLAQHFAHNPPPDDLV
                          :  *:*:****: ****   *   *  *  *******.*  ::.**:  .    ***:

ref|YP_146903.1|         FVFQPAEEGPGGAKPMLESDIMREWKPDIIVALHIAPEYPVGTIATKEGLLFANTSELFI
ref|YP_001125035.1|      FIFQPAEEGPGGAKPMLESDIMREWKPDMIVALHIAPEYPVGTIATKEGLLFANTSELFI
ref|YP_001646604.1|      FIFQPAEEGPGGALPMLESDELKEWKPNMILGLHIAPEYSVGTIATKEGLLFANTSELYV
ref|YP_001375911.1|      FLFQPAEEGPGGALPMLESEELKEWKPNMILGLHIAPEYPVGTIATKEGLLFANTSELYI
ref|ZP_01696300.1|       FIFQPAEEGPGGAKAMLEEVLHDEWQPDLVMALHVAPEYPAGTVAVKKGLLFANTSELYI
RAAC00529                LVFQPAEEGPGGAQPMLASEAFQAVRPEMIFALHVQPDMAVGEIGIRPGVLFANTSELFI
                         ::*********** .**  .    :*:::..**: *:  ..* :. : *:********::

ref|YP_146903.1|         DLKGKGGHAAFPHLANDMVVAACALVTQLQSIVARNVDPLDSAVITIGKIAGGTVQNVIA
ref|YP_001125035.1|      DLKGKGGHAAFPHLANDMVVAACALVTQLQSIVARNVDPLDSAVITIGKITSGTVQNVIA
ref|YP_001646604.1|      DLKGKGGHAAYPHTANDMIVAASHLVTQLQSVISRNVNPLDSAVITIGKITGGTVQNIIA
ref|YP_001375911.1|      DLKGKGGHAAYPHMANDMIVAASHLVTQLQSVISRNVNPLDSAVITIGKITGGTVQNIIA
ref|ZP_01696300.1|       DLEGKGGHAAYPQHTKDMVVAAAHLVTQLQSIISRNIDPLDSAVVTIGKITGGTVQNAIA
RAAC00529                HLVGQGGHAAYPHRANDMVVAGAHLVTALQTIVARNVDPLDSAVITVGRLESGTKMNIIA
                          .* *:*****:*:  :::.. * :::: **** *::*::  .**  * ** ref|YP_146903.1|         EHARLEGTIRTLSTAAMQKVKRRIEAIVHGIEVAYECEASIDYGAMYHEVYNDPDLTAEF
ref|YP_001125035.1|      EHARLEGTIRTLSIDAMQAVKRRIEALVRGVEVAYECEAVIDYGAMYHEVYNNPALTTEF
ref|YP_001646604.1|      EKSRLEGTIRTLSVESMKRVKSRIEAIVAGIEASFQCEAVIDYGAMYHQVYNHEELTREF
ref|YP_001375911.1|      EKSRLEGTIRTLSVESMKRVKDRIEAIVAGIEAAFQCEAVIDYGAMYHQVYNHEALTKEF
ref|ZP_01696300.1|       EHARLEGTIRTLSSEAMEKVKHRIEALTNGLSAGFECRAEIDYGCNYYQVFNHPEETARF
RAAC00529                ERARLEGTVRALNAATMPRLKNRIEAVVAGIERMFNCQAEIDYGANYQVYNDERLTRGF
                         *::****:*:*.    :*    :* *:* **** :*.. ::*.* ****. *::*:*.  *   * ref|YP_146903.1|         MKFAKAHGGVNVIRCKEAMTGEDFGYMLADIPGFMFWLGVASPYGLHHAKLAPNEEAIDR
ref|YP_001125035.1|      IQFAETHTDMNVIRCKEAMTGEDFGYMLAEIPGFMFWLGVDSPYGLHHAKLVPNEAAIDR
ref|YP_001646604.1|      MQFTREQTTMDVITCTEAMTGEDFGYMLREIPGFMFWLGVNSEYGLHHAKLKPDEEVIEK
ref|YP_001375911.1|      MEFASKDTNMNVVTCKEAMTGEDFGYMLRDIPGFMFWLGVDSEYGLHHAKLKPNEAAIDR
ref|ZP_01696300.1|       MDFVRSYEGAHLHECREALTGEDFGYMLKEIPGFMFWLGVGSPYGLHHAKFAPDERALET
RAAC00529                MQFVEEAGLADVHEVPPAMTGEDFGYFLREIPGFLFWLGAATPYGLHHAKMLPDERCIDV
                         :.*.           .:    *:*******:* :****:****.  :  ******: *:*   ::

ref|YP_146903.1|         AIAFLIDYFS------
ref|YP_001125035.1|      AIAFLISYFS------
ref|YP_001646604.1|      AIVFLNQY--------
ref|YP_001375911.1|      AIEFLNQY--------
ref|ZP_01696300.1|       AADLMIAY--------
RAAC00529                ALRVLIPYFAERRYEA
                         *  .:  *
```

FIG. 6

```
ref|NP_846569.1|         -------MKQVQTKRD----WKKLAYDVVEEKMITKEDAIAILEADDTEVLEIMNAAYII
ref|ZP_00238879.1|       -------MKQVQTKRD----WKKLAYDVVEEKMITKEDAIAILEADETEVLEIMNAAYII
ref|YP_896466.1|         -------MKQVQTKRD----WKKLAYDVVEEKMIAKEDAIAILEAEDTEVLEIMNAAYII
ref|YP_001376041.1|      -------MKQIQTKVD----WKKIAFEGIEGKRITKEDALAILEADDTEVLEIMNAAYMI
dbj|BAB39458.1|          -------GLETLVKKD----WKMLAENVIKGYKVTAEEALAIVQAPDNEVLEILNAAFLI
RAAC00552                ----MHEGALTMMKIDYQTNWIDLARRVLDGRGVTREEALDILRSSDDELLDLLAAAFLI
                                  *  *   *  :*      :.      ::  *:*:  *:.:  :  *:*::: **::* ref|NP_846569.1|         RHHYFGKKVKLNMIINTKSGLCPEDCGYCSQSIISEAPIDKYAWLTQEKIVEGAHEAIRR
ref|ZP_00238879.1|       RHHHFGKKVKLNMIINTKSGLCPEDCGYCSQSIISEAPIDKYAWLTQEKIVEGAHEAIRR
ref|YP_896466.1|         RHHYFGKKVKLNMIINTKSGLCPEDCGYCSQSIISEAPIDKYAWLTQEKIVEGAHEAIRR
ref|YP_001376041.1|      RHHYFGKKVKLNMIINTKSGLCPEDCGYCSQSIVSEAPIDKYAWLTQEKIVEGAHEAVRR
dbj|BAB39458.1|          RQHYYGKKVKLNMIINTKSGLCPEDCGYCSQSIVSEAPIDKYAWLTKEKIVEGAQESIRR
RAAC00552                RRRYFGKKVKLNMIINAKSKMCPEDCAYCSQSAISKAPVSKYPLVSKEEIIAGAREAERR
                         *:::: **********:**  :***** *****  *:*:**.**.  :::*:*:  **:*:  **

ref|NP_846569.1|         KAGTYCIVASGRRPTDKEVNHVIGAVKEIRETTDLKICCCLGFLNEDQAGRLAEAGVHRY
ref|ZP_00238879.1|       KAGTYCIVASGRRPTDKEVNHVIGAVKEIRETTDLKICCCLGFLNEDQAGRLAEAGVHRY
ref|YP_896466.1|         KAGTYCIVASGRRPTDKEVNHVIGAVKEIRETTDLKICCCLGFLNEDQAGRLAEAGVHRY
ref|YP_001376041.1|      KAGTYCIVASGRRPTDKEVNHVIGAVKEIKETTDLKICCCLGFLNEDQAKRLAEAGVHRY
dbj|BAB39458.1|          KAGTYCIVASGRRPTNREIDHVIEAVKEIRETTDLKICCCLGFLNETHASKLAEAGVHRY
RAAC00552                KAGTYCIVISGRRPSDREIERIAEAVEEIRATTTLKICCCLGLLTPAQADRLARAGVHRY
                         ******  ***:::*:::   ::  *******:*.   :* :.**** ref|NP_846569.1|         NHNLNTHANNYESICSTHTYDDRVDTVQKAKQAGISPCSGAIFGMGETIEERAEIAFELQ
ref|ZP_00238879.1|       NHNLNTHANNYESICSTHTYDDRVDTVQKAKQAGISPCSGAIFGMGETIEERAEIAFELQ
ref|YP_896466.1|         NHNLNTHANNYENICSTHTYDDRVDTVQKAKQAGISPCSGAIFGMGETIEERAEIAFELQ
ref|YP_001376041.1|      NHNLNTHANHYDNICSTHTYDDRVDTVEKVKQAGISPCSGAIFGMGETKEERVEIAFELQ
dbj|BAB39458.1|          KHNLNTSQDNYKNITSTHTYEDRVDTVEAVKEAGMSPCSGAIFGMNESNEEAVEIALSLR
RAAC00552                NHNLNTSRDRYGDICTTHTYDDRVRTLEHVKEAGISPCSGVIFGMGESDEEAVDMAFALK
                         :*****  :. *  .* :****:*** *: .*:**:*****.****.*: **  .::*: *:

ref|NP_846569.1|         RIDADSIPCNFLVAVKGTPLEGQKELTPVECLKVLAMMRFVNPTKEIRISGGREINLRSV
ref|ZP_00238879.1|       RIDADSIPCNFLVAVKGTPLEGQKELTPVECLKVLAMMRFVNPTKEIRISGGREINLRSV
ref|YP_896466.1|         RIDADSIPCNFLVAVKGTPLEGQKELTPVECLKVLAMMRFVNPTKEIRISGGREINLRSV
ref|YP_001376041.1|      RLDADSIPCNFLVSVKGTPFEGRKELTPVECLKILAMMRFVNPSKEIRLAGGRELNLRSV
dbj|BAB39458.1|          SLDADSIPCNFLNAIDGTPLEGTSELTPTKCLKLISMMRFVNPSKEIRLAGGREVNLRSM
RAAC00552                EMDADSIPCNFLNPIPGTPLEGMETLNPRRCLKLLCMMRFVNPSKEIRIAGGRERNLRSL
                         .:**********  .:  ***:**  . *.*  .***::: .*******:**** ****:

ref|NP_846569.1|         QPIGLFAANSIFVGDYLTTAGQEPTADWGMIEDLGFEIEECAL
ref|ZP_00238879.1|       QPIGLFAANSIFVGDYLTTAGQEPTADWGMIEDLGFEIEECAL
ref|YP_896466.1|         QPIGLFAANSIFVGDYLTTAGQEPTADWGMIEDLGFEIEECAL
ref|YP_001376041.1|      QPLGLFAANSIFVGDYLTTVGQESTADWEMIQDLGFEIEECAL
dbj|BAB39458.1|          QPMALYAANSIFVGDYLTTAGQEPTADWGIIEDLGFEIEECAL
RAAC00552                QVLGLYPANSIFVGDYLTTPGQAPTEDWAMIEDLGFEIEECAL
                         *  :.*:.**********  **   *  ** :*:**********
```

FIG. 7

```
ref|NP_833836.1|              ------------------MSGFFITATDTEVGKTVVAGAIAGVFRELGYNVGVYKPLQS
ref|ZP_00739346.1|            ------------------MSGFFITATDTEVGKTVVAGAIAGVFRELGYNVGVYKPLQS
ref|YP_085454.1|              ------------------MSGFFITATDTEVGKTVVAGALAGVFRELGYNIGVYKPLQS
ref|YP_001646745.1|           ------------------MSGFFITATDTEVGKTVVTGALAGIFRERGHNVGVYKPLQS
ref|YP_001376045.1|           ------------------MSGFFITATDTEVGKTVVTGAIAGGLRKLGHHIGVYKPLQS
RAAC00553                     METISVSGRWRNLLHGRRTMKGLFITATDTEVGKTWVTGVLACALRHRGYDVGVCKPIQS
                                                *.*:***********  *:*.:*   :*. *:.:** **:**

ref|NP_833836.1|              GHVASNPEGDAARLKSLSGVPTQENEICPYSIEEPLAPRLAMKRAGRVVKLKEITDYYNG
ref|ZP_00739346.1|            GHVASNPEGDAARLKVLSGVPTQENEICPYSIEEPLAPRLAMKRAGRVVKLKEITDYYNE
ref|YP_085454.1|              GHVASNPEGDAARLKALSGVPTKEDEICPYSIEEPLAPRLAMKRAGRTVTLKDIHHHYNE
ref|YP_001646745.1|           GHVASNPEGDAARLKALSGVPTKEDEICPYSIEEPLAPRLAMKRAGRTVMLKEITAHYNE
ref|YP_001376045.1|           GHSASHPEGDAARLKMASGVETAVDKICPYSVEEPLAPRLAMQRAGRTVTLADITSYYNE
RAAC00553                     GNHLDDPEGDAAKLKRLAGVSDSVSDICLCALPHPVAPQLALKLSGLDLFLDHVLSFVGQ
                              *:  . .******:**  :**   ..**  ::  .*:**:**::  :*   :  *  ..

ref|NP_833836.1|              LLKEFNSLFVEGAGGLAVPYTEDALVIDFAKELQLPLIVVARPTLGTVNHTVLTIAYAKA
ref|ZP_00739346.1|            LLKEFNSLFVEGAGGLAVPYTEDALVIDFAKELQLPLIVVARPTLGTVNHTVLTIAYAKA
ref|YP_085454.1|              RLKEFNSLFVEGAGGLAVPYTEDALVIDFAKELQLPLIVVARPTLGTVNHTVLTIAYAKA
ref|YP_001646745.1|           LLKEFNSLFVEGAGGLAVPYTEDALVIDFAKELQLPLIVVARPTLGTVNHTVLTISYAKA
ref|YP_001376045.1|           LMAEFDSLLVEGAGGLAVPYTEDALVVDFAKQLKLPLIIVARPTLGTVNHTVLTISYAKA
RAAC00553                     AAKRHEWVFVEGAGGVAVPYLSDAWLVDVIQALNFPVLLVARAGLGTINHTILSIEYLNR
                                ..: ::******:****  .** ::*. : *:::***. ***:***:*:* * :

ref|NP_833836.1|              HGLTVAGVIL----------SGCKECEMERVQE--------------NKE----------
ref|ZP_00739346.1|            HGLTVAGVIL----------SGCKECEMERVQE--------------NKE----------
ref|YP_085454.1|              HGLTVAGVIL----------SGCKECEMERVQE--------------NKV----------
ref|YP_001646745.1|           HGLTVAGVIL----------SGCKECECERVQE--------------NKE----------
ref|YP_001376045.1|           KGLQVAGVIL----------SGCKEDEKERVQE----------NKK--------------
RAAC00553                     RGIRVLGVVLN---------RGSDTYADDAPDKQ--------ISFLLERTN-------SD
                              :*: * **:*          *..       :  ::

ref|NP_833836.1|              MIEELSGVPVLGLLPFFAGEFTKEEVLESAKEHI------------------
ref|ZP_00739346.1|            MIEELSGVPVLGLLPFFEGEFTKEEVLESAKEYI------------------
ref|YP_085454.1|              MIEELSGVPVLGLLPFFEGEFTKKEVLESAKEYI------------------
ref|YP_001646745.1|           MIEELSGVPVLGLLPFLEGEFTKEELLESVKEHI------------------
ref|YP_001376045.1|           MIEELSDVPVFGLFPKIREEYTRDELIKAAEESIQI----------------
RAAC00553                     YIREATGVPVFGVLPNMSSCTVELEIVNAVEQNIDVLGIAKSMNAIYERPNV
                               *.*  :.***:*::*   :         ..  *:::::.:: *
```

FIG. 8

```
sp|P22806|BIOF_BACSH    ------------MNDRFRRELQVIEEQGLTRKLRL-FSTG-NESEVVMNGKKFLLFSSNN
dbj|BAB39457.1|         ------------------ELEKIKEGGLYRQLQT-VETMSDQGYAMVNGKKMMMFASNN
ref|NP_390900.1|        ----------------LNERLDRMKEAGVHRNLRS--MDGAPVPERNIDGENQTVWSSNN
ref|ZP_01667656.1|      ---------------·-VTEALAEIKRHGLYRQIPD--YDPVDAVHVVEDGRRYLMLASNN
ref|YP_147981.1|        ------------MKTELTVKLHEWEQKAQKRQLRR---AEASGATVILNGKPMLNLASNN
RAAC00554               --------MLKSLESRIVNELFDLREAGRHRSLHS---TVVRGARMWLESKEVLHFSSND
                                *   ... *.:                    :..      :**:

sp|P22806|BIOF_BACSH    YLGLATDSRLKKKATEGISKYGTGAGGSRLTTGNFDIHEQLESEIADFKKTEAAIVFSSG
dbj|BAB39457.1|         YLGIANDQRLIEASVQATQRFGTGSTGSRLTTGNTIVHEKLEKRLAEFKQTDAAIVLNTG
ref|NP_390900.1|        YLGLASDRRLIDAAQTALQQFGTGSSGSRLTTGNSVWHEKLEKKIASFKLTEAALLFSSG
ref|ZP_01667656.1|      YLGLTHDPAVREAAAAALRYGAGSGGARLTTGSHPLFAELERELAAFKGTEAALVFNTG
ref|YP_147981.1|        YLGLADDRRLIEAGCEAMRAYGAGAGASRLVVGNHPLYERAEAALKQWKKAEAALIFNSG
RAAC00554               YLALSFDHRVREAAQAASHEYGAGATGSRLISGNHPEIEGLEAELASWHGAEASLVFSSG
                        **.::  *    :   .    .:*:*: ..**  *.     *   :  :: ::*::::.:* sp|P22806|BIOF_BACSH    YLANVGVISSVMKAGDTIFSDAWNHASIIDGCRLSKAKTIVYEHADMVDLERKLRQSHGD
dbj|BAB39457.1|         YMANIAALTTLVGSDDLILSDEMNHASIIDGCRLSRAETIIYRHADLLDLEMKLQINTRY
ref|NP_390900.1|        YLANVGVLSSLPEKEDVILSDQLNHASMIDGCRLSKADTVVYRHIDMNDLENKLNETQRY
ref|ZP_01667656.1|      YMANVGIISALAGPGDVLFSDELNHASIIDGCRLARAKVVVYRHADAGHLAECLATTPCA
ref|YP_147981.1|        YTANIGVLTALIGRDDLVFSDKLNHASLIDGIRLSKAACFRYRHHDIDQLESLLKQSPPA
RAAC00554               YAANVGVLSALVRSDDVVFSDELNHASLIDGCRMTRARVVVYRHADVQHLEQLMRETPCR
                        *  **:. ::::     * ::** ****:***  *::::   .  *.*  *.*   :   .

sp|P22806|BIOF_BACSH    GLKFIVTDGVFSMDGDIAPLPKIVELAKEYKAYIMIDDAHATGVLGNDGCGTADYFGLKD
dbj|BAB39457.1|         RKRIIVTDGVFSMDGDIAPLPGIVELAKRYDALVMVDDAHATGVLGKDGRGTSEHFGLKG
ref|NP_390900.1|        QRRFIVTDGVFSMDGDTIAPLDQIISLAKRYHAFVVVDDAHATGVLGDSGQGTSEYFGV--
ref|ZP_01667656.1|      GRRLIVTDGVFSMDGDIAPLDQIVPLAEQYDALVMVDDAHATGVIGPGGRGTTAYFGLKG
ref|YP_147981.1|        KRKWIVTDAVFSMDGDMAPLEELVELKRRYRAVLLVDEAHSGGVFGPNGEGLLHHFGLEK
RAAC00554               GQRFVVSDAVFSMDGDIAPIAELIEIARLFEAVVILDDAHGVGMLGRRGAGTLENFGIVN
                         : :*:*.****** :**:  ::  : . : *  ::::*:**.  *::*   *    **:

sp|P22806|BIOF_BACSH    EIDFT-VGTLSKAIGAEGGFVSTSSIAKNYLLNNARSFIFQTALSPSAIEAAREGISIIQ
dbj|BAB39457.1|         KIDI-EMGTLSKAVGAEGGYIAGSRSLVDYVLNRARPFVFSTALSAGVVASALTAVDIIQ
ref|NP_390900.1|        CPDIV-IGTLSKAVGAEGGFAAGSAVFIDFLLNHARTFIFQTAIPPASCAAAHEAFNIIE
ref|ZP_01667656.1|      RVHI-EMGTLSKALAAEGGYVAGRRELIDYLVNKARSFIFSTALAPATVAAATAALRELA
ref|YP_147981.1|        EEDVIAIGTFSKALGSFGAYVTGEPWLVDYLINSARSLIFTTALPPSVLAANEAAIHIVQ
RAAC00554               VDDIVYIGTLSKALGAEGGYVAGRKILIEYLVNRARSFIFSTGLSPMVASSARKARSIAE
                          .. :**:***:.: *.:  :       :::::*  **..::*  *.:..    :    .

sp|P22806|BIOF_BACSH    N----EPERRKQLLKNAQYLRLKLEESGFVMKEGETPIISLIIGGSHEAMQFSAKLLDEG
dbj|BAB39457.1|         S----EPERRVRIRAMSQRLYNELTSLGYTVSGGETPILAIICGEPEQAMFLSKELHKHG
ref|NP_390900.1|        A----SREKRQLLFSYISMIRTSLKNMGYVVKGDHTPIIPVVIGDAHKTVLFAEKLQGKG
ref|ZP_01667656.1|      A----RPALVATLQANARYLRDRLNEAGFNVASSVTAIIPVIVGEADAAVAMARSLKEAG
ref|YP_147981.1|        A----EPKRRERLHALSERFRTKLKRLGFDTGGSETPIVPVIVGPNDRAVAMSEQLQEAG
RAAC00554               L----EDWRRQKVLSLSSALRTSLQQLGYVVRGGETPIVPVIVGDEHSSLTISRHLMSYG
                              :     :       :    *   *: .  *.*::: *   . :: ::   *    * sp|P22806|BIOF_BACSH    VFIPAIRPPTVPKGSSRLRITVMATHTIEQLDMVISKIK------
dbj|BAB39457.1|         IYAPAIRSPTVPLGTSRIRLTLMATHQEEQMNHVIDVFR------
ref|NP_390900.1|        IYAPAIRPPTVAPGESRIRITITSDHSMGDI--------------
ref|ZP_01667656.1|      LIVSAIRPPTVPPGTCRLRLTVSAAHSREDL--------------
ref|YP_147981.1|        IAAVAIRPPTVPEGTARIRFSITAAMTEEDIDMAVDCI-------
RAAC00554               IYVPAIRPPSVPEGKCRLRFSLTAAHEMTDVRLVIDVLKDWKPSR
                        :  ***.*:*. * .*:*:::  :        ::
```

FIG. 9

```
ref|YP_001126681.1|        ------IFLNGEFVTKENAKISVYDHGFLYGDGVFEGIRVYSGNVFRLEEHIDRLYNSAK
ref|YP_148515.1|           ------IFLNGEFVTKENAKISVYDHGFLYGDGVFEGIRVYSGNVFRLEEHIDRLYNSAK
ref|ZP_01171798.1|         ------IFLNGEFVTKENAKISVYDHGFLYGDGIFEGIRVYSGNIFRMKEHMDRLYRSAK
ref|YP_080106.1|           ------IFLNDKLVKKEDAKISVYDHGFLYGDGVFEGIRVYDGNIFRMQEHMDRLYDSAR
ref|YP_001374758.1|        ------IYMNGELVEKEKAVVSVYDHGFLYGDGVFEGIRSYGGNVFCLKEHVKRLYESAK
RAAC00632                  MDVASQVFLDGEFVSSDAASVSVFDHGLLYGDGVFEGIRAYDGNVFRLKPHMDRLYRSAK
                                 ::::.::* .: *  :**:***:*****.*.**:*  :: *:.*** **:

ref|YP_001126681.1|        SIMLNIPYTKDEMINHVLETVRRNGYQDAYIRLVVSRGVGDLGLDPYKCKSPQVVIIVEP
ref|YP_148515.1|           SILLDIPYTKEEMIGHVLETIRRNGYQDAYIRLVVSRGVGDLGLDPYKCKTPQIVIIVEP
ref|ZP_01171798.1|         SILLTMPYTEEEELTDIIVATVEKNLYEDAYIRVVVSRGVGDLGLDPYNCKKANVVVIVEP
ref|YP_080106.1|           SIMLEIPYPQEELTQHVLKTVEKNGLKDAYIRLVVSRGAGDLGLDPNNCSNPSVIIIVEP
ref|YP_001374758.1|        SILLTIPMTVEEMEKAVVQTLQKNGYADAYIRLIVSRGKGDLGLDPRSCEKPSVIIIAEQ
RAAC00632                  SILLEIPYTQDELTELVCETVRRNHLSSAYIRLVVTRGSGDLGLNPYNCAKARVFIIAEQ
                           **:* :*  . :*:    : *:..* .****::*: ***:*  .* .. :.:*.* ref|YP_001126681.1|        LALFPKHLYETGIEVVTVATRRNRSDVLSPKVKSLNYLNNVLVKIEAHLANVSEALILND
ref|YP_148515.1|           LALFPKHLYETGIEVVTVATRRNRSDVLSPKVKSLNYLNNVLVKIEAHLANVSEALILND
ref|ZP_01171798.1|         LSIFPKELYETGLEIVTVATRRNRPDVLSPKVKSLNYLNNVLVRIEARLANVSEALMLND
ref|YP_080106.1|           LAIFPKHLYETGIDIVTVPTRRNRPDVLSPKVKSLNYLNNILVRIEAHMAGVTEALMLND
ref|YP_001374758.1|        LKLFPQEFYDNGLSVVSVASRRNMPDALDPRIKSMNYLNNVLVKIEAAQAGALEALMLNQ
RAAC00632                  LSMFPKALYEQGIRAITAATRRTGDVLNPKIKSLNYLNNILIKMEAIHAGANEAIVLNH
                           *  :**:  :*: *:   ::..:**.  *.*.*:**:*****:*::::** *.. **::**.

ref|YP_001126681.1|        QGYVAEGSGDNIFIVKNGVVYTPPGYVGALEGITRQAIIEIAEELGYTVKEEPFTRHDVY
ref|YP_148515.1|           QGYVAEGSGDNVFIIKNGVIYTPPGYVGALEGITRQAIIEIAEDLGYTVKEEPFTRHDVY
ref|ZP_01171798.1|         QGYVAEGSADNVFIIKDKCFYTPPGYVGALEGITRNAVMEIARELGYEVKEEPFTRHDVY
ref|YP_080106.1|           QGYVAEGSADNVFIYKNGKLLTPPGYIGALEGITRNAIIEIARELGYEVKEEPFTRHDVY
ref|YP_001374758.1|        QGYVCEGSGDNVFVVKDGKVVTPPSYLGALEGVTRNSVIELCDKLGIPCEERPFTRHDVY
RAAC00632                  EGYVVEGSGENIFLVRDGVLITPPAYLGALEGITRQAVIDLAPALGLEVRQEPFTQHDVY
                           :* *.:*:*:*:. ::   . ***.*:***::::::: .    ..:.*:**** ref|YP_001126681.1|        VADEVFLTGTAAEVISVIKVDGRTIGDGTPGPHTKRLLEEFRRRVIAEGVKV-----
ref|YP_148515.1|           VADEVFLTGTAAEVISVIKVDGRTIGDGTPGPHTKRLLEEFRRRVVVEGVKV-----
ref|ZP_01171798.1|         TADEVFLTGTAAEVIAVVKVDGRTIGEGYPGAHTKELLVKFRERVVSEGVKV-----
ref|YP_080106.1|           TAEEVFLTGTAAEVIAVVKVDGRKIGDGKPGVHTNRMLEKFRERVVREGLKV-----
ref|YP_001374758.1|        VADEVFLTGTAAELIPVVKVDAREIGDGKPGEVTKQLTEAFKRLTRERGVRVPG---
RAAC00632                  VADEVFLTGTAAEIVPVVEVDRRAIGHGVPGPVTKRVHAAFQEIVRADGVRIEGARV
                           .*:**********:::.*::** * **.* ** *:.:    *:.:      *:::
```

FIG. 10A

```
ref|NP_243928.1|      MRSDMIKKGIDRAPHRSLLRAAG-VKEE-EMDKPFIGVCNSYIDIIPGHMHLNKFAEVAK
ref|YP_176142.1|      MRSNMIKKGIDRAPHRSLLRAAG-VKEE-DMDKPFIGVCNSYIDIIPGHMHLNKFAEVAK
ref|ZP_01695378.1|    MRSDMIKKGIDRAPHRSLLYAAG-LKTE-DFDKPFIGVCNSYIDIIPGHRHLNKFAEVVK
ref|ZP_01725506.1|    MRSDMIKVGVDRAPHRSLLYATGKVKAK-DLGKPFIGVCNSYIDIIPGHVHLRTFADVVK
RAAC00633             MRSDMIKVGVDRAPHRALLYATG-VKPR-DLSKPFIGVCNSYVDIVPGHVHLREFAEVVK
ref|YP_850199.1|      MRSDKIKKGVEQAPARSLLHATGQIKSPGDMDKPFIAICNSYIDIVPGHVHLRELADVAK
                      *:  *::*** *:** *:* :*   ::.**.:::* . :*:*.* ref|NP_243928.1|      EAIREAGGIPFEFNTIGVDDGIAMGHIGMRYSLPSREIICDAAETVINAHWFDGVFFIPN
ref|YP_176142.1|      EAIIEAGGIPFEFNTIGVDDGIAMGHIGMRYSLPSREIICDAAETVINAHWFDGVFYIPN
ref|ZP_01695378.1|    EAIREAGGVPFEFNTIGVDDGIAMGHIGMRYSLPSRELIADSAETVINAHWFDGVFYIPN
ref|ZP_01725506.1|    EAIIEAGGIPFEFNTIGVDDGIAMGHIGMRYSLPSREIIADSAETVINAHWFDGVFYIPN
RAAC00633             DAIRQAGGVPFEFNTIGVDDGIAMGHIGMRYSLASRELIADSAETMINAHWFDGVFFIPN
ref|YP_850199.1|      EAIREAGGIPFEFNTIGVDDGIAMGHIGMRYSLPSREVIADAAETVINAHWFDGVFYIPN
                      : :*:****************** .*:*.*:*:*******:* ref|NP_243928.1|      CDKITPGMLMASVRTNVPSVFVSGGPMEAGRTKDGKNLSLASVFEGVGAFSSGKMTREEL
ref|YP_176142.1|      CDKITPGMLMAAVRTNVPAVFVSGGPMEAGRTKEGKSLSLVSVFEGVGAFSSGKMTREEL
ref|ZP_01695378.1|    CDKITPGMLMAAVRTNVPAVFVSGGPMEAGMAPDGKQLSLTSVFEGVGAHKSGKISYEEL
ref|ZP_01725506.1|    CDKITPGMLMAAVRTNVPSIFVSGGPMEAGTSASGKQLSLTSVFEGVGAHKSGNMSAEEL
RAAC00633             CDKITPGMLMAAVRCNVPAVFVSGGPMEAGRSRTGRPLSLSSVFEGVGQYMSGQISEDDL
ref|YP_850199.1|      CDKITPGMLLASVRTNVPAIFCSGGPMKAGLSAHGKALTLSSVFEAVGAFKDGSMSQEDF
                      *********:*:** ***:* ****** **   *: *:* ****.**  .*.:: :::

ref|NP_243928.1|      LEIEQTACPTCGSCSGMFTANSMNSLMEMLGMALPGNGTIVATSEARHQLIKDAAKHLMN
ref|YP_176142.1|      LEIEQLACPTCGSCSGMFTANSMNSLMEMLGLALPGNGTLVATSTERHNLIKDAAKHLIN
ref|ZP_01695378.1|    KMLETSACPTCGSCSGMFTANSMNSLMEMLGLTPPGNATIVATSEERHRIIREAVGHLMN
ref|ZP_01725506.1|    LDIENNACPTCGSCSGMFTANSMNCLMEMLGVALPGNGTIVATSEERHKLIKEAAKQLIR
RAAC00633             LDLERNACPTCGSCSGMFTANSMNCIMEMLGIALPGNGTLVATSKERHELIYEAAKHLIR
ref|YP_850199.1|      LDMEANACPTCGSCAGMFTANSMNCLMEILGMAVPGNGTTLAVSDARRELIRESAFHLMD
                      :*  ********:******** :**:**::  ***.* :*.*  *:.:* ::. :*:

ref|NP_243928.1|      LIEKDIRPRDIITKETIDDAFALDMAMGGSTNTVLHTLAIANEAEIE-YDLNRINEVAER
ref|YP_176142.1|      LIEKDIRPRDIVTEETIDDAFALDMAMGGSTNTVLHTLAIANEAEID-YDLTRINEVAER
ref|ZP_01695378.1|    CIKNDIRPRDIVTEEAIDDAFALDMAMGGSTNTVLHTLAIAREAGID-YDLERINKVAER
ref|ZP_01725506.1|    MVKEDIKPRDIITKEAIDDAFALDMAMGGSTNTVLHTLAIANEAEID-YNIEDINKVAER
RAAC00633             MVEQDIRPRDIITREAIDDAFALDMAMGGSTNTVLHLMAIAHEAGID-YSLSDINEIAKR
ref|YP_850199.1|      LVKKDIRPRDIITKDAIDDAFALDMAMGGSTNTVLHTLALANEAGIEDYDLERINDIAKR
                      ::::**:*.::******************** :*:*.** *: *.:  **.:*:* ref|NP_243928.1|      VPYLCKISPASDYSMDDVHHAGGVAAIIKELCEIDGAIHPDRITITGKSIYENVKDAEIT
ref|YP_176142.1|      VPYLCKISPASDYSMDDVHKAGGVAAIMKELIE-MGAVKGDRITITGKSLYENVAHAQIT
ref|ZP_01695378.1|    VPYLAKIMPASDYSMHDVHLAGGISAIVHELCKIEGAIHPGRLTITGKSIYENVKDAEIR
ref|ZP_01725506.1|    VPYLAKIMPASDISMDDINKAGGVSAIINELVSIPGAIHPNRPTVAGVTMGELVKDHHIT
RAAC00633             VPYLAKISPASEYSIQDVHRAGGVSAIIRELCEHTDAVHPDRITVTGKTLYEQVKDAKIL
ref|YP_850199.1|      VPYLSKIAPSSSYSMHDVHEAGGVSAIVKELVDLGGAIHPDRITVTGKTIRENVADAKIN
                      **. *:*. *:.*:: *:::.**  .  .*:: .* *::* ::  * . .* ref|NP_243928.1|      DDVVIRRKDNPYSPVGGLSILFGNLAPNGAVIKVGAVDPSIQIFEGEAIVYNSQEEAQQG
ref|YP_176142.1|      NTDVIRTKETAYSPVGGLSILYGNLAPDGAVIKVGAVDPSIKTFTGEAIVFNSQEEAQEQ
ref|ZP_01695378.1|    NPEVIRPKENPYSPVGGLSILYGNIAPDGAVIKVGAVDPDIHTFTGEAIVFESQEEAQKG
ref|ZP_01725506.1|    NNQVIRTKENPYSAVGGLSVLFGNIAPEGSVIKVGAVDPSIQVFKGQAIVFDSQEEAAQEN
RAAC00633             DERVIRPASNPYSREGGLSILFGNLAPDGAVLKVGAVDPDIQRFVGRAICFNSQDEAMEG
ref|YP_850199.1|      NTDVIHPKENPYSPVGGLSMLFGNIAPKGAAIKVGGVDPSVQVFKGEAICFSSHDEAVEA
                      :  **:   ...** *****:*:**:**..***.*.::: * *.** :.*:: * :
```

FIG. 10B

```
ref|NP_243928.1|      INNGDVREGHVVVIRYEGPKGGPGMPEMLAPTSAIIGRGLGTKVALITDGRFSGASRGIS
ref|YP_176142.1|      INNGAVKEGQVVVIRYEGPKGGPGMPEMLAPTSAIQGRGLGTKVALITDGRFSGASRGIS
ref|ZP_01695378.1|    IDSGLVHEGHVVVIRYEGPKGGPGMPEMLAPTSSIMGRGLGKTVALITDGRFSGATRGIC
ref|ZP_01725506.1|    IDNGIVKEGHVVVIRYEGPKGGPGMPEMLAPTSAIQGRGLGTKVALITDGRFSGASRGIS
RAAC00633             INSGKVQPGHVVVIRYEGPKGGPGMPEMLAPTSSIVGRGLREVALITDGRFSGATRGIC
ref|YP_850199.1|      IDNHTVREGHVVVIRYEGPKGGPGMPEMLAPTSSIVGRGLGKDVALITDGRFSGATRGIA
                      *:.   *:  *:************************:*  ***** ************:***.

ref|NP_243928.1|      IGHISPEAAEGGPIAFIENGDKIRIDLPNRTIEWLVSDEEIAKRQ-EGWTEPEPKVKK--
ref|YP_176142.1|      IGHISPEAAEGGPIAFVENGDMIKIDLIERTIEWEISEEELAKRR-EGWTEPEPKVKK--
ref|ZP_01695378.1|    VGHISPEAAEGGPIALVENGDRITIDLINRRIELHVPDEELQRRK-QNWVQPEPKITS--
ref|ZP_01725506.1|    IGHISPEAAEGGPIALVEDGDMIEIDLPNRTINLQVSEEVLAERR-AKLPVFEPKIKR--
RAAC00633             VGHISPEAGVGGPIALVEDGDEIEIDIPNRAITLKVSDEELAARR-ARYQPPAKEKLT--
ref|YP_850199.1|      VGHISPEAAAGGPIALVHDGDIITIDLPNRTLNVDVSDEVLEERR-KELPKFKAKVKT--
                      :*******. *****::.:**  *  **: :*  :    :.:*  :  *:          :

ref|NP_243928.1|      -GYLARYSKLVTSANTGGVMKI--
ref|YP_176142.1|      -GYLARYSKLVTSANTGGVMKI--
ref|ZP_01695378.1|    -GYLARYSALVTSANTGGVLKI--
ref|ZP_01725506.1|    -GWLARYSKLVTNASTGGVMKI--
RAAC00633             -GYLARYQKLVTSANTGAVLTVDA
ref|YP_850199.1|      -GYLARYTALVTSAHTGGILQI--
                      *:****   ***.* **.:: :
```

FIG. 11A

```
ref|YP_148514.1|         --QGGSTMTKMKVEEQEKARTKAR------MSGSLMLIEALKEEKVEVIFGYPGGAVLPL
gb|AAL99356.1|           ------------------------------MSGSMMLIEALKAEQVEVIFGYPGGAVLPL
ref|YP_001126680.1|      ------------------------------MSGSLMLIEALKAENVEVIFGYPGGAVLPL
ref|YP_001487695.1|      ------------------------------MNGALMLIEALKREKVEVIFGYPGGAVLPI
ref|YP_176141.1|         ------------------------------GSEILLKALASEGVEVIFGYPGGAILPT
RAAC00634                MWRGGNAMPGMSKPADDETLTRSGEGGAMWMKGADMVVEALRREQVEVIFGYPGGAVLPL
                                                       *:  ::::**   * ***********:**

ref|YP_148514.1|         YDELYKAGVFHVLTRHEQGAIHAAEGYARISGKPGVVIATSGPGATNIVTGLTDAMMDSL
gb|AAL99356.1|           YDELYKAGVFHVLTRHEQGAIHAAEGYARISGKPGFVIATSGPGATNIVTGLTDAMMDSL
ref|YP_001126680.1|      YDELYKAGVFHVLTRHEQGAIHAAEGYARISGKPGVVIATSGPGATNIVTGLTDAMMDSL
ref|YP_001487695.1|      YDKIYDSGLFHVLPRHEQGAIHAAEGYARVSGKPGVVIATSGPGATNLVTGIADAMIDSL
ref|YP_176141.1|         YDEIYKLGMNHILARHEQGAIHAAEGYARITQKPGVCIVTSGPGATNVVTGIADAMMDSL
RAAC00634                YDALYQCGIRHVLTRHEQGAIHAAEGYARVTGKPGVVIATSGPGATNLVTGLADAMMDSI
                         **  :*. *:  *:*.*************::   ***. *.*******:***::***:**:

ref|YP_148514.1|         PLVVFTGQVATSVIGSDAFQEADVVGITMPITKHNYQVRDISELPRIIKEAFHIATTGRP
gb|AAL99356.1|           PLVVFTGQVATSVIGSDAFQEADVVGITMPITKHNYQVRDISELPKIIKEAFHIATTGRP
ref|YP_001126680.1|      PLVVFTGQVATNVIGSDAFQEADVVGITMPITKHNYQVRDISELPKIIKEAFHIATTGRP
ref|YP_001487695.1|      PLVVFTGQVATSVIGSDAFQEADVLGITMPITKHSYQVRNPEELPGVIKEAFHIATTGRP
ref|YP_176141.1|         PMVVITGQVATKVIGTDAFQEEADMLGITMPITKHNFQIRSIEELAQTVKEAFHIAVSGRP
RAAC00634                PLVAITGQVAKTVIGTDAFQETSIIGSTPITKHNYQIRHASEIPKVFKEAFHIANSGRK
                         *:*.:*****..***:*****:.::**:  *****.:*:*   .*:.  .****** :**

ref|YP_148514.1|         GPVLIDIPKDITTAEGEFDYDQDVHLPGYQPTTQPNHWQIRRLVEAVSQSKRPVILAGAG
gb|AAL99356.1|           GPVLIDIPKDITTAEGEFDYDEEVCLPGYQPTTQPNHWQIRRLVEAVSQSKRPVILAGAG
ref|YP_001126680.1|      GPVLIDIPKDVTIAEGEFDYNQDVHLPGYQPTTQPNHWQIRRLVEAVSQSKRPVILAGAG
ref|YP_001487695.1|      GPVLIDIPKDVAGIEGTFEYDQPIDLPGYQPKVEPNYLQIRKLVEAVSRAKKPVILAGAG
ref|YP_176141.1|         GPVLIDLPKDISEKLGIFDYEEPVHLPGYQPTVKPNKQQIRKLLDKFKEAKRPVLLVGAG
RAAC00634                GPVLIDIPKDVSGEEAWFAYDDPPQLPGYQPTVVPHHMQIRKLMHGLQHAKRPVVLAGAG
                         ****:*::    . * *::  ******..  *:    ***:*:.   ...:*:**:*.*** ref|YP_148514.1|         ILHANASNELRQYAEQQNIPVIHTLLGLGGFPADHPLFLGMAGMHGTYTANMALCECDLL
gb|AAL99356.1|           VLHADAANELRQYAEQQNIPVVHTLLGLGGFPADHPLFLGMAGMHGTYTANMALYECDLL
ref|YP_001126680.1|      VLHANAADELQQYAEQQNIPVAHTLLGLGGFPADHPLFLGMAGMHGTYAANMALYECDLL
ref|YP_001487695.1|      VLHGKASEELRQYVEQQQIPVAHTLLGLGGFPAKHPLFLGMAGMHGTYAANMALHQCDLL
ref|YP_176141.1|         VLHAQASEELTAFARKFQIPVAQTLLGLGAFPGEEELHLGMAGMHGTYAANMALHKSDFL
RAAC00634                VLHARATEKLLAFVEKYQLPVVQTLLGLGSFPASHPLCLGMGGMHGSAAANKALYETDFL
                         :**. *::::*    :...: ::  :**....   * *.:  : **  :  *:* ref|YP_148514.1|         INIGARFDDRVTGNLKYFAPKATVAHIDIDPAEIGKNVPTKIPIVSDAKAALQELIAQQG
gb|AAL99356.1|           INIGARFADRVTGNLKYFAPKATVAHIDIDPAEIGKNVPTKIPIVSDAKAALQELIAQQG
ref|YP_001126680.1|      INIGARFDDRVTGNLKYFAPKATVAHIDIDPAEIGKNVPTKIPIVSDAKAALQELIEQQG
ref|YP_001487695.1|      ISIGARFDDRVTGNLNHFAKHAKVAHIDIDPAEIGKNIHTHIPVVGDSKLVLQELIKQDG
ref|YP_176141.1|         INIGSRFDDRLTGALEHFAPEACIAHIDIDPAEIGKNVHVEIPVVGDAKEALAMLVKGSG
RAAC00634                INLGARFDDRLTGKLEHFAPHAVVAHIDIDPAEIGKNVPTDIPVVGDVGEALSMMLSIDV
                         *.::::** **:** *::**  .*  :**************:  ..**:*.*     .*   ::   .

ref|YP_148514.1|         KPADTAAWLTQLDEWKRRFPLHYEP-EAGTIKPQKLIEMIYEMTNGEAIVTTDVGQHQMW
gb|AAL99356.1|           KPADNAAWLEQLNEWKRRFPLHYEP-EAGTIKPQKLIEMIYELTNGEAIVTTDVGQHQMW
ref|YP_001126680.1|      KPADNAAWLAQLNEWKRRFPLHYEP-EAGAIKPQKLIEMIYEVTGGEAIVTTDVGQHQMW
ref|YP_001487695.1|      KQGESDEWKNQLDQWKEEYPLWYVENEAEGFKPQKLIEYIHQFTKGEAIVATDVGQHQMW
ref|YP_176141.1|         AIDEHDEWRKQVSDWKRDYPLWFHR-DGEVIKPQELIQKLYEHTKGEAIVTTDVGQHQMW
RAAC00634                PAPDAEAWREELLRVKRELPFWWVQ-DGKHIKPQRLISEIARITKGDVVVTTDVGQHQMW
                         :     *  ::   *.  *:  *::    :.  :***.**.    :   *  *:..:*:********
```

FIG. 11B

```
ref|YP_148514.1|         AAQYYKFNRPHRWVTSGGLGTMGFGLPAAIGAQLADRSATVVSIVGDGGFQMTFQELSVI
gb|AAL99356.1|           AAQYYKFNRPNRWVTSGGLGTMGFGLPAAIGAQLADRSATVVSIVGDGGFQMTLQELSVI
ref|YP_001126680.1|      AAQYYKFNRPNRWVTSGGLGTMGFGLPAAIGAQLADQSATVVSIVGDGGFQMTCQELSVI
ref|YP_001487695.1|      AAQFYPFENADKWVTSGGLGTMGFGLPAAIGAQLADQEATVVAILGDGGFQMTLQELAVI
ref|YP_176141.1|         TAQHFKFNKPNRWITSGGLGTMGFGFPAAIGAQIAEPELPVLAITGDAGFQMTLQEMSIL
RAAC00634                AAQFFPLNQPDRWVTSGGLGTMGFGLPAAIGAHFGQPDKLVVAILGDAGFQMTLQELAVI
                         :**.:  ::...:*:**********:*****::.:  . *::* **.***** **::::

ref|YP_148514.1|         QELRLPIKIVIVNNQALGMVRQWQELFYDKRYSHSLIPNQPDFVKLAEAYGMPGLRAKTE
gb|AAL99356.1|           RELGLPIKIVIVNNQALGMVRQWQELFYEKRYSHSLIPNHPDFVKLAEPYGIPGLRAKTE
ref|YP_001126680.1|      QELQLPIKVVIVNNQALGMVRQWQELFYDKRYSHSLIPNQPDFVKLAEAYGMPGLRAKTE
ref|YP_001487695.1|      RELNLPVKVIVLNNHSLGMVRQWQEIFYEERYSYSKFSEQPDFVKLSEAYGIKGIRISSD
ref|YP_176141.1|         QELDLPVKIVIVNNASLGMVRQWQQRFHGERYSHSLFPIQPNFAKLAEAYNIKAVKVDKL
RAAC00634                GEHQLPIKVVIVNNSALGMVRQWQELFHGERYSESLLPWQPDFVKLGEAYRIPSARVERD
                           *  **:*:::** :********: *: :*** * :. :*:*.**.*.*  :  : .

ref|YP_148514.1|         AEAAEVLKQAFAMDGPVLLDFHVRADENVYPMVAPGKGLHEMVGVK-
gb|AAL99356.1|           AESAEVLKQAFAMDGPVLLDFHVRADENVYPMVSPGKGLHEMVGVK-
ref|YP_001126680.1|      AEAAEVLKQAFAIDGPVLLDFHVCADENVYPMVAPGKGLHEMVGVK-
ref|YP_001487695.1|      EEAKEKLEEALTSREPVFIDVNVARDEKVFPMVAPGKGLHEMVGVKP
ref|YP_176141.1|         SMLDEAIAETLAHPGPVLLEVCVAKEENVYPMVCPGTGHHCMEGVEP
RAAC00634                EDLTAALEAFLSEPGPGLLECVVDPNENVYPMVAPGTGIHQMVGRP
                              :   ::  *  :::  *   :*:*:***.**.*  *  **.
```

FIG. 12

```
ref|NP_389472.1|      --IAFLFPGQGSQFIGMGKELYEQVPAAKRLFDEADETLETKLSSLIFEGDAEELTLTYN
ref|ZP_01861659.1|    --IAFVFPGQGSQKAGMGKELSEKFPQVEEYFKKADQRLGFDLSTLIFEGPQDKLTLTEN
ref|YP_147042.1|      --IAFLFPGQGSQTVGMAKDAAEHDDRARAVIAEADERLGFALSKLMFNGPQEELTLTYN
ref|NP_243358.1|      --VAFLFPGQGSQSVGMGSELLSEEK-AKEIFDEADERLGYSLSSIMFEGPEEKLRRTEN
ref|YP_175798.1|      --IAFLFPGQGSQKVGMGATLFAEDSLAKEVLERADKALGFPLSEIIEHGPEEKLKQTAY
RAAC00174             MNVAFVFPGQGAQYVGMGRAIFDEYPVARALLEEADEALGMKLSDIIFEGPEDTLRLTYY
                        ::***:*  .      .  .. :.: *   ** ::  .*  : *   * ref|NP_389472.1|      AQPALLTTSIAVLEKFKES-GITPDFTAGHSLGEYSALVAAGALSFKDAVYTVRKRGEFM
ref|ZP_01861659.1|    AQPALLTTSIAFLQML-ESEGVKPDYTAGHSLGEYSALVAAGAISFEDGVYAVRKRGEYM
ref|YP_147042.1|      AQPALLTASIALLQ-LVDGAGLKADYVAGHSLGEYTALVAAGAMSFADAVYAVRRRGELM
ref|NP_243358.1|      TQPALLTMSTAVL-SLVREYGIKPDYTAGHSLGEYSALVASGSLTFADAVYAVHHRGLFM
ref|YP_175798.1|      AQPALVTMSTAVLQLFRD-AGIQADFVAGHSLGEYSALVACKSLTFEDAVTLVHQRGTLM
RAAC00174             TQPALLTVSVAVWRALVDRVDIQPLAVAGHSLGEYSALVAAKSISFADAVKLVYQRGKLM
                      :****:* * *.    :     .: .  .******:**. :::* *.*   * :** * ref|NP_389472.1|      NEAVPAGEGAMAAILGMDAEALKQVTDKVTEE-GNLVQLANLNCPGQIVISGTAKGVELA
ref|ZP_01861659.1|    EEAVPAGEGTMAAVLGMGRDQLSEITERISAE-GNHVGLANLNCPGQIVISGSFRGVELA
ref|YP_147042.1|      DEAVPAGEGTMAAVLGMDADALEAVTNEIAAQ-GDPVEPANFNCPGQIVISGSKAGVEKA
ref|NP_243358.1|      EEAVPFGEGAMAAILGMERDELEQVTKRVTE-AGAVVELANLNCPGQIVISGSAEGVEQA
ref|YP_175798.1|      EEAVPQGQGAMAAVLGLNKEELEEVASEIAAD-GEVAELANLNCPGQIVLSGTAKGIEQA
RAAC00174             DEAYPAGQGTMAAVLGLDEEPLREVCKRASEETGEIVELANVNCPGQIVISGAKAAVERA
                      :** * *:*:*::   : *  :..  :     *  .  .***::  ..:* * ref|NP_389472.1|      SELAKENGAKRAIPLEVSGPFHSELMKPAAEKLKEVLDACDIKDADVPVISNVSADVMTE
ref|ZP_01861659.1|    SDLAKEEGAKRVLPLQVSGPFHSSMMKPAAENFSGVLDEIAIRDAEVPVIANVNAEPMIS
ref|YP_147042.1|      AQLLKERGAKRVIPLEVSGPFHSALMKPAAEKLKAVLDSLVIRDAVIPVVANVTAEPVTK
ref|NP_243358.1|      SEEAKEAGAKRVIPLQVSGPFHSSLMKPAAEKLEAVLADLAIADAAPPVIANVTADLVQK
ref|YP_175798.1|      AVLAKQKGAKRVLPLAVSGPFHSSLMKPAADQFKQALEQAPFANPTVPLIANVTAEVTDA
RAAC00174             SLLAKEAGARRVMPLNVSGPFHSSLMQPAADRLGALLDEIEFADAETPVVANVDGHPRRM
                      :   *: **:*.:** ******* :*:***:.:    *    : :.  *:::**  ..

ref|NP_389472.1|      KADIKEKLIEQLYSPVRFEESINKLIAEGVTTFIEIGPGKVLSGLVKKVNRRLKTIAVSD
ref|ZP_01861659.1|    ASEIKERLIQQLYSPVLWEDTVVKLLDAGVDTFIEIGPGKVLSGLIKKVNRRVNTFSISD
ref|YP_147042.1|      KEDIARLLIEQLYSPVRWEQSVRTLLSLGVDTFVEIGPGKVLSGLVKKIDRNARVYAVND
ref|NP_243358.1|      AADIRSSLIEQVYSPVRWEDTVRRMLELGVDTFVEIGSGNVLSGLVRKVQRRVNVFSVSD
ref|YP_175798.1|      PEVIREQLAEQIYSPVRFEESVRRMIELGVDTFIEIGAGNVLCGLVRKIDRNLRTFAVSD
RAAC00174             ASDLRDALKKQLVMPVRFVDCVLSMKRLGVDCVVELGPGTVLSGLVRKIDKSLETAHAED
                      :   * :*:      :    :       .:*:*.*..::*:::     .* ref|NP_389472.1|      PETIE--------------
ref|ZP_01861659.1|    -------------------
ref|YP_147042.1|      LASFEATVAAL--------
ref|NP_243358.1|      RASIE--------------
ref|YP_175798.1|      RESFEKMAAAL--------
RAAC00174             PATLDEVCALLTRGGESGE
```

FIG. 13

```
ref|YP_148513.1|        ----------------------------------MRRIITMTVNNRPGVLNRITGL
ref|YP_001126679.1|     ----------------------------------MRRIITMTVNNRPGVLNRITGL
ref|NP_843875.1|        ----------------------------------MKRIVTATVRNQSGVLNRITGV
ref|NP_243926.1|        ----------------------------------MKRTITALVNNTSGVLNRITGL
ref|YP_176140.1|        ----------------------------------MKRTITVLVNNKSGVLNRMTGL
RAAC00635               ----------------------------------MTPVLSVLVHNKPGVLNRITAL
                                                          *   ::  *.* .*****:*.:

ref|YP_148513.1|        FTKRHYNIESITVGHTEIEGISRMTFVVNVDDERTAEQIIKQLNKQIDVLKVNDITDQAI
ref|YP_001126679.1|     FTKRHYNIESITVGHTEIDGVSRMTFVVNVDDERIAEQIIKQLNKQIDVLKVSDITDQAI
ref|NP_843875.1|        MTRRHFNIESISVGHTESSDISRMTIVVHVENEQQVEQLIKQLHKQIDVLKVSDITEEAM
ref|NP_243926.1|        FARRHFNIESITVGVTENPTVSRMTFVVIVDNQKNIEQVIKQLHKQVDVLKVKDITDEAI
ref|YP_176140.1|        FARRQYNIDSITVGVTENPTISRMTFVVFVDSMENVEQMIKQLHKQVDVLKIKDITDEAI
RAAC00635               FMRKGFNIQSLTVCITENPEISRMTIVMSDMDEAALEQVIKQLHKQIDVLKVTDLTDQAM
                        :  ::  :**:*::*  **   :****:*:    .    **:****:**:****:.*:*::*:

ref|YP_148513.1|        VARELALIKVAAPPAVRQEIYTLIEPFRASIVDVSKDSLVIQVTGEPEKVEALIELLRPY
ref|YP_001126679.1|     VARELALVKVAAAPATRQEIYTLIEPFRASIVDVSKDSLVIQVTGEPEKVEALIELLRPY
ref|NP_843875.1|        IARELALIKVATSVA-RAELYSLIEPFRAAVIDVGKDSIVVQVTGTQEKVEALIELLRPY
ref|NP_243926.1|        VARELALIKVVASPQQRGEIAAVVNPFRASIIDIGRESMTVQITGDHQKVETFIDLLRPY
ref|YP_176140.1|        VERELALVRVGATPQQRGEIASLAETFRAQAVDIGKESMTLQITGNNEKIEAFIELVKPY
RAAC00635               VARELALIRVSSPIAERAVIHSLIEPFRANIVDVGRETVTVQVTGDAEKIDALIALLRPY
                        : *****::*  :.   *  : :: :.***   :*:.:::::.:*:**  :*::::* *::**

ref|YP_148513.1|        GIKEVARTGTTAFTRGA----------------
ref|YP_001126679.1|     GIKEVARTGTTAFTRGAQKAGSNQK--------
ref|NP_843875.1|        GLKEIARTGVTAFTR------------------
ref|NP_243926.1|        GIKELARTGITAFKR------------------
ref|YP_176140.1|        GIQELARTGVTAVNRSSKVSTDTSR--------
RAAC00635               GIRELARTGLTALPREAASSADPKRAGEAQVLHI
                        *::*:****  **. *
```

FIG. 14

```
ref|YP_148510.1|         ----------IAVLPGDGIGKEVTSGAVEVLKAVGIRFGHEFTFEYGLIGGAAIDEAGTP
ref|YP_001126676.1|      ----------IAVLPGDGIGKEVTSGAVEVLKAVGIRFGHEFTFEYGLIGGAAIDEVGTP
ref|ZP_01171803.1|       ------MKKRIAVLPGDGIGKEVAAGAVEVLQAAGERFGHTFEFSYGKIGGTAIDSTGVP
ref|NP_243923.1|         ------MEKQIAVLPGDGIGPEVTDAAIEVLQAVADRFGHTFSYKKALLGGCAIDEVGTP
RAAC00637                MKGTDGMTKNIAILPGDGIGREVTAEAVKLIQVVAASRGETWNLEEGLIGGSALDATGSP
ref|NP_926497.1|         ----------IAVLPGDGIGTEIVQVGVAMLEAAARRFDFAFDFEEAPIGGAAIDATGEP
                                   :****  *:.    .:  ::: ...     .    :  . .  :**  *:*  .*  * ref|YP_148510.1|         LPEETLRLCRESDAVLLGAVGGPKWDDNPPHLRPEKGLLAIRKQLDLYANLRPVVCYDSL
ref|YP_001126676.1|      LPEETLRLCQQSDAVLLGAVGGPKWDQNPPHLRPEKGLLAIRQQLGLYANLRPVVCYDSL
ref|ZP_01171803.1|       LPDETVELCKSSDAILLGAVGGPRWEKLHPSLRPERGLLKIRKDLNLYANLRPTSYFASV
ref|NP_243923.1|         LPEETLDVCRHADGILLGAVGGPKWDTLPGHLRPEKGLLGLRKGLNLFANLRPVTVYDSL
RAAC00637                LPEETVRLCRAADAVLLGAVGGPKWDHLPGDKRPEAGLLGIRKALEVYANLRPIRTWPGL
ref|NP_926497.1|         LPAATLELCKASDAVFLGAVGGPQWDTLPSDKRPEKALLGLRAGLGLFANLRPARILPQL
                         **    *:   :*:   :*.::*******:*:        ***  .**   :*    *    ::*****                :

ref|YP_148510.1|         VSASPLKPDLVQGVDFVIVRELTGGIYFGQPSGRV-VENGEEKAVDTLLYKKEEIERIVR
ref|YP_001126676.1|      DSASPLKSDLVQGVDFIIVRELTGGIYFGQPSGRV-VENGEEKAVDTLLYKKEEIERIVR
ref|ZP_01171803.1|       ADSSPLRKEVIEGTDFLMVRELTGGLYFGKPSERA-GNGSEETAVDTLFYKKEEVQRVVR
ref|NP_243923.1|         ADASTLKNDVIDGVDLLIVRELTGGLYFGEPRERR-GEGETEEVVDTLLYTRGEMRRIIR
RAAC00637                LLASPLKPELVEGVDFIIVRELTGGLYFGQPKARL-DGG--EAVVDTLHYTRAEIRRVVK
ref|NP_926497.1|         VAASALKPEVVEGVDILVVRELTGGLYFGIPKGIFPEKKGGRRGVNTMSYSAFEIERIGR
                          :*.*:   :::::*.*::::*******:***  *           .  *:*:  *.   *:..*:  :

ref|YP_148510.1|         MAFILARGRKKKVTSVDKANVLSSSRLWREVAEEVAKQFPDVTLEHMLVDNAAMQLIRAP
ref|YP_001126676.1|      MAFTLARGRKKKVTSVDKANVLSSSRLWREVAEEVAKQFPDVELEHMLVDNAAMQLIRAP
ref|ZP_01171803.1|       LAFELARGRDGKVTSVDKANVLESSRMWRETAEEIAAQYPDIQLEHMLVDNAAMQIIKNP
ref|NP_243923.1|         KAFELAMVRNKHVTSVDKANVLESSRMWREVANEVAQEFPEVTLEHMLVDNAAMQLIRRP
RAAC00637                VAFELAKGRQGRLTSVDKANVLESSRVWREVVEEVASEYPGVLVEHLLVDNAAMQIITRP
ref|NP_926497.1|         VAFEAARERRGKLCSVDKANVLEVSQLWREVLVGLAPEYPDVELTHMYVDNCAMQLVRRP
                          **    *    * :: ********. *::***.    :*   ::*   :    *:  *.*::   * ref|YP_148510.1|         KQFDVIVTENMFGDILSDEASMLSGSLGMLPSASLSASGPSLYEPVHGSAPDIAGMNKAN
ref|YP_001126676.1|      KQFDVIVTENMFGDILSDEASMLSGSLGMLPSASLSASGPSLYEPVHGSAPDIAGMRKAN
ref|ZP_01171803.1|       KQFDVIVTENMFGDILSDEASVLTGSLGMLPSASLSEGGPYLYEPIHGSAPDIEGKGIAN
ref|NP_243923.1|         KQFDVLVTENLFGDILSDEASMVTGSLGMLPSASLTSDGPGLYEPIHGSAPDIAGKGVAN
RAAC00637                KTFDVIVTENMFGDILSDEAAVITGSIGMLPSASLGEAGPGLYEPVHGSAPDIAGQGLAN
ref|NP_926497.1|         RQFDTIVTENMFGDILSDEAMLTGSIGMLPSASLGSGGPGLYEPVHGSAPDIAGQDKAN
                         : .::***** ::::****      **:****  *   ** ref|YP_148510.1|         PIAAILSAAMMLRLSFGLTAEAEAVEHAVRQALDQGLRTADLAPSGGRIVSTNEM-----
ref|YP_001126676.1|      PIAAILSAAMMLRLSFGLTAEAEAIEHAVQQALTAGLRTADLAQSNGRVVSTDEM-----
ref|ZP_01171803.1|       PVGMILSAAMMLRLSFGMEEEAAAIEKAVSDVLESGIRTADLA-SGGKAASTKVMTEEIK
ref|NP_243923.1|         PLATIASCAMMLKYSFGLHEEAKTIEDAIEAVLKQGYRTADIAKPGEESSSTKAITDAVV
RAAC00637                PLATFLSVALMMRHSLHLPEAADAIEQAVHGVIERGVRTRDLARSGEAFVKTADVSAMVC
ref|NP_926497.1|         PLAQVLSGAMLLRHSLRQPEAAQAVERAVQTVLEQGYRTGDIAAPGAQIV----------
                         *:. . * *::::   *:        * ::*  *:      .:   * **  *:*  ..

ref|YP_148510.1|         --------
ref|YP_001126676.1|      --------
ref|ZP_01171803.1|       AALLDN--
ref|NP_243923.1|         EAIQ----
RAAC00637                EDVKRRLG
ref|NP_926497.1|         --------
```

FIG. 15A

```
ref|YP_148509.1|        ------------KTIIDKIWENHVVYREEGKPDLLYIDLHLVHEVTSPQAFEGLRQKGRK
ref|YP_001126675.1|     ------------KTIIEKIWENHVVYREEGKPDLLYIDLHLVHEVTSPQAFEGLRQNGRK
ref|YP_075945.1|        ---------MSGRTLLDKIWERHVVRREPGKPDLLYIDLHLVHEVTSPQAFEGLRMAGRR
RAAC00638               MRRREKEARLMGRTLFEKVWDAHVVKELPDGQTLLYIDLHLVHEVTSPQAFAGLRFAGRK
ref|NP_243922.1|        ------------KTIIEKIWDAHTVIGEEGKPSLLYIDLHMVHEVTSPQAFEGLRLAGRP
ref|ZP_01171804.1|      ----------MGKSIVEKIWDRHIVHTETDKPDLLYIDLHLVHEVTSPQAFSGLRMKNRK
                                    :::..:*:*:  *  *    .   ****:****** *  .* ref|YP_148509.1|        VRRPDLTFATMDHNVPTVN-RFVITDEVARNQIAALERNCREFGIPLADLHSEEQGIVHV
ref|YP_001126675.1|     VRRPDLTFATMDHNVPTVN-RFVITDEVARNQIAALERNCREFGIPLADLHSEEQGIVHV
ref|YP_075945.1|        VRRPDLTIATMDHNVPTTDRSLPLTDEIAARQMAALERNCSEFGVRLFDLYSPFQGIVHV
RAAC00638               VRRPELTFATMDHNVPTVN-PKDVRDAIARKQIETLEQNCREFGVQLAGLDSPFQGIVHV
ref|NP_243922.1|        VRRPDLTFATMDHNVPTVD-RFNIQDQIARKQIETLEANCKEFGIEIAGLDSPNNGIVHV
ref|ZP_01171804.1|      VRRPDKTFATMDHNVPTIN-RGQIDDPVAKKQMTTLEKNCREFGVPLAGMDSPDQGIVHV
                        ****: *:********* :      : * :* .*: :  ***: : .:  *  :***** ref|YP_148509.1|        IGPELGLTQPGKTIVCGDSHTSTHGAFGALAFGIGTSEVEHVLATQTLWQHKPKTLQICI
ref|YP_001126675.1|     IGPELGLTQPGKTIVCGDSHTSTHGAFGALAFGIGTSEVEHVLATQTLWQHKPKTLQIRI
ref|YP_075945.1|        IGPELGLTQPGLTIVCGDSHTATHGAFGALAFGIGTSEVEHVLATQCLWQHKPKVMEIRI
RAAC00638               IGPELGLTMPGKTIVCGDSHTSTHGAFGALAFGIGTSEVEHVLATQCLWQSRPKTMRIQL
ref|NP_243922.1|        IGPELGLTQPGKTIVCGDSHTSTHGAFGALAFGIGTSEVEHVLATQTLWQSKPKTMEVRV
ref|ZP_01171804.1|      IGPELGLTRPGMTIVCGDSHTSTHGAFGSLAFGIGTSEVEHVLATQTLWQSRPKTLKLQI
                        ******** ** *********:******:*************** *** :**:...: :

ref|YP_148509.1|        NGRLGKGVTAKDVILAIIGRYGVGVGTGYIIEFTGEAIRRMSMEERMTICNMSIEAGARA
ref|YP_001126675.1|     NGQLGKGVTAKDVILAIIGRYGVGVGTGYIIEFTGEAIRRMSMEERMTICNMSIEAGARA
ref|YP_075945.1|        NGKLPPGTTAKDLILGIIGQIGTDGATGYVIEYTGEAIRSLSMEGRMTVCNMSIEAGARA
RAAC00638               NGTLQPGVTAKDVILGLIAKYGVNFGTGHVVEYAGSLIPELSMEQRMTICNMSIEFGARA
ref|NP_243922.1|        TGELAPSVSAKDIILAVIAKYGVDFGTGHVIEFTGEAIRSLSMEERMTICNMSIEAGAKA
ref|ZP_01171804.1|      DGRLESGVTAKDVILYIISRFGIGFGTGHVIEYCGEAVRSMSMEERMTICNMSIEGGARA
                          * *   ..:*: :*.: * .  ::: *. :  :* *:**** :* ref|YP_148509.1|        GLISPDETTFAYLRGRKYAPKGEEFDKAVERWRALASDEGAKYDKTIEIDASTIAPMVTW
ref|YP_001126675.1|     GLISPDETTFAYLRGRKYAPKGEEFDQAVERWRALASDEGAEYDKTIEIDASTIAPMVTW
ref|YP_075945.1|        GMIAPDETTFAYLKGRPHAPQGELWEAAVADWRTLASDPDAVYDRVVEFDAGQLAPVVSW
RAAC00638               GMMAPDETTIAYVQGRRYAPKGADWEACVAAWRELKSDPDAVFDVDVVFDVNDLEPQVTW
ref|NP_243922.1|        GLISPDSVTFEYLRGRPNAPKGEAFDVAIQQWEALATDAGAVYDRVLTMNASEIEPMVTW
ref|ZP_01171804.1|      GLVSPDETTFSYIKGRKYAPKDNEWDTSLAHWQALASDPDANYDKEITLDAGEIPPMVSW
                        *:::**..*: *::  :.    ::  .:  *. * :*  .* :*   : .  * *:* ref|YP_148509.1|        GTNPAMSTSVDGVVPHPEQFESKTEQNAVRRALEYMGLKPGTPITDIPVQHVFIGSCTNS
ref|YP_001126675.1|     GTNPSMSTSVDGTVPDPEQFESETERNAVRRALEYMGLKPGMSITEIPVQHVFIGSCTNS
ref|YP_075945.1|        GTNPGQVVPVTGRIPDPRDFADPAQRKAAEEAALAYMDLEPGTPIQDIRIDRVFIGSCTNG
RAAC00638               GTNPGQGTGISGVVPDPKDAKSEEEALAIRQALEYMDLKPGTKISEIPIQHVFIGSCTNA
ref|NP_243922.1|        GTNPAQGTGVSQVVPSPDDAKDENERRAIKQSLAYMGLEPGTPITEIAIQHVFIGSCTNS
ref|ZP_01171804.1|      GTNPSMAAGVDERIPSEADCKTETERTSLERALRYMGLSEGQEISDISIQHVFIGSCTNS
                        ****.  . :  :*   :       : : ..:* **.*.  *  * :* :::*********.

ref|YP_148509.1|        RLSDLRAAASIVKGKKVAPGVRALVVPGSQQVKKQAEAEGLAQIFIDAGFEWRDSGCSAC
ref|YP_001126675.1|     RISDLREAAKIVKGQKVAPGVRALVVPGSQQVKKQAEEEGLAQIFLDAGFEWRDAGCSAC
ref|YP_075945.1|        RIEDLRAAAAVVKGRKVAPGVRAMVVPGSQQVKAQAEAEGLDQIFREAGFEWREAGCSMC
RAAC00638               RIEDLRLAASIVKGRRVADGVRAVVVPGSKQVKQQAEAEGLHEIFLEAGFEWREPGCSAC
ref|NP_243922.1|        RLSDLRTAAELIKGRKVADGVRALVVPGSQQVKRAAEKEGLDEIFKEAGFEWRDSGCSMC
ref|ZP_01171804.1|      RIEDLRQAAEFAAGKKVHPGVRALVVPGSQAVKEQAEKEGLHHIFIESGFEWRESGCSMC
                        *:.*** **  .  *::*  ****:*****  **  ** ***  .**  ::*****:.*** *
```

FIG. 15B

```
ref|YP_148509.1|        LGMNPDIIPEGEHCASTSNRNFEGRQGKGARTHLVSPVMAAAAAIYGHFVDVRQLEAEPV
ref|YP_001126675.1|     LGMNPDIIPEGEHCASTSNRNFEGRQGKGARTHLVSPAMAAAAAIYGRFVDVRQLEAEPV
ref|YP_075945.1|        LGMNPDILAPGERCASTSNRNFEGRQGKGGRTHLVSPAMAAAAAIAGHFVDVRELLAEGG
RAAC00638               LGMNPDIIPAGERCASTSNRNFEGRQGKGARTHLVSPAMAAAAAIAGHFVDVRELTSEGV
ref|NP_243922.1|        LGMNPDTVPEGERCASTSNRNFEGRQGKGARTHLVSPQMAAAAAIAGHFVDVRTFQSEPQ
ref|ZP_01171804.1|      LSMNNDIVPPGEHCASTSNRNFEGRQGSGARTHLVSPLMAAAAAVNGKFVDVRKTLMEES
                        *.**  * :. :***********.*.**** ****: *:*****      * ref|YP_148509.1|        --
ref|YP_001126675.1|     --
ref|YP_075945.1|        AA
RAAC00638               TA
ref|NP_243922.1|        T-
ref|ZP_01171804.1|      IT
```

FIG. 16

```
ref|YP_148508.1|              -MKPFTIHRGKTAGIDRANIDTDQIIPKQFLKRIERTGFGQFLFYDWRYLSDGTPNPEFE
ref|YP_001126674.1|           -MKPFTIHRGKTAGIDRVNIDTDQIIPKQFLKRIERTGFGQFLFYDWRYLSDGTPNPEFE
sp|Q67MJ3|LEUD_SYMTH          -MRPFTRETGLAVPLDRVNVDTDQIIPKQFLKRIERTGFGQFLFHDWRYLPDGSPNPEFV
RAAC00639                     MMEPMVRHEGLVVCMNRVNVDTDQIIPKQFLKRIERDGFGEFLFFDWRYLPDGSPNPDFE
ref|YP_080099.1|              -MEPLKTHNGIAAVLNRINVDTDQIIPKQFLKRIERTGYGRFAFFDWRYLDNGDPNPDFE
ref|YP_001487689.1|           -MEPLVTHKGKAAVLNRINVDTDQIIPKQFLKRIERTGYGRFAFFDWRYLADGSPNPDFE
                               *.*:   . *  .. ::* *:************** *:*.* *.***** :* ***:* ref|YP_148508.1|              LNRPENEGATILVADENFGCGSSREHAPWALQDYGFRVIIAPSFADIFYNNCLKNGLLPI
ref|YP_001126674.1|           LNRPENEGATILVAGDNFGCGSSREHAPWALQDYGFRAIIAPSFADIFYNNCLKNGLLPI
sp|Q67MJ3|LEUD_SYMTH          LNRPQYAGATILIAGRNFGSGSSREHAPWALSDYGFRAIIAPSFADIFYNNCFQNGLLPV
RAAC00639                     LNQPEAQGATILLVDDNFGCGSSREHAVWALRDYGFRVILAPSFADIFYNNCFKNGLLPI
ref|YP_080099.1|              LNRPEYKGASILIAGENFGCGSSREHAPWALDDYGFKIIIAPSFADIFHQNCFKNGMLPI
ref|YP_001487689.1|           LNQPIYEGSSILIAGENFGCGSSREHAPWALDDYGFKIVIAPSFADIFHQNCFKNGMLPI
                              **:*    *::**:.. ***.****** *** ****:  ::*********:.**::**:**:

ref|YP_148508.1|              RLDKEDVRYLLR-QSERADY-ELTVSLEEQRVFDDEGFSRPFDIDPYRKQLLLKGWDEID
ref|YP_001126674.1|           RLDQEDVRYLLQ-QSERADY-ELTVSLEEQRVFDDEGFSRPFDIDPYRKKLLLKGWDEID
sp|Q67MJ3|LEUD_SYMTH          VLPEEAVAELMR-RAQEPGY-RLTVDLERCVVEDDAGFRVDFAIDAFRRHRMLHGLDDIG
RAAC00639                     RIPRELYKQLSE-SHARGEWRRMTVDLEQQMAATDHGVTFSFEIDPHKRHMLLRGLDDIG
ref|YP_080099.1|              RLPYEAWKELAEQY-EYQSL-TMTVDLEKQTITDHAGRQIAFEVDPHWKEMLLNGYDEIS
ref|YP_001487689.1|           RLDYDVWKTFAASY-ENKGY-EMTVDLEKQQIEDHEGNITPFDVDPHWREMLLNGYDEIS
                                :   :     :              :**.**.     . *   *  :*.. :.  :*.*  *:*.

ref|YP_148508.1|              LTFVYEAHIAAYERRHCP------
ref|YP_001126674.1|           LTFVYESHIAAYEQKHCP------
sp|Q67MJ3|LEUD_SYMTH          LTLQYEDEIAAYEA-RRP------
RAAC00639                     ITLQYEADIAAYEASRRPYQFVYA
ref|YP_080099.1|              LTLLLEEEIEQFEKQR--------
ref|YP_001487689.1|           LTLLLEDDIQAFEDKR--------
                              :*:   *  .*   :*    :
```

FIG. 17A

```
gb|ABV27286.1|              ------FVKGLEGVLAAQSSICFIDGAAGRLTYRGIDIHVLAEH-STFEE
RAAC00642                   MAAETTFKAGLEDVVSNTSEICFLDGKQGRLLYYGYDIHDLVDGGASFEE
ref|YP_826036.1|            -----TTTAGLEGIIAGESEICYIDGYLGILSYRGFNIHTLADN-AKFEE
gb|AAL17866.1|AF424980_1    -----TVTRGLEGVVATTSSISSII--DDTLTYVGYNIDDLADN-ASFEE
ref|ZP_01859643.1|          -----TATRGLEGVVATTSSISSII--DDTLTYVGYNIDDLTNN-ASFEE
ref|NP_244026.1|            ---------GLEGVVATTSSVSSII--ESVLTYQGYDIDELAEH-ASFEE
                                     ***.::: *.:. :    . * * * :*. *.: :.*** gb|ABV27286.1|              TAYFLLFGHLPKQAELDAFTKQLQAEREVPTEIYTLLRTLPPT-ATPMEV
RAAC00642                   VVYLLWHGELPNQSELKAFTEELASERALAEPVLDLLKRLPKD-ANAMAV
ref|YP_826036.1|            VIFLLWNGWLPRQAELDALKAALVAERELPGAIVDFLKSAPK--VNTMDL
gb|AAL17866.1|AF424980_1    VIFLLWHRKLPTKSELEELKILLAENAELPKEILDHFKMYPIDKVHPMAA
ref|ZP_01859643.1|          IIYLLWNLKLPTASELDALKKDLAENAALPKEVIEHFKMYPIKDVHPMAA
ref|NP_244026.1|            VIYLLWNGKLPNKVELKELADELANNAEIPQEVIEQMKAYPLDRVHPMGA
                            ::*        .  :    *   : :.  :    ::  *   . .* gb|ABV27286.1|              LRTATSALSAYDPDGPDNSDEANVRKGIRLIARMTTLTTAYDRIRRGLEP
RAAC00642                   LRTAVSFLGLYDPDDGDESLEANYRKAARLVAKIPTIVTSYERIRQGLDP
ref|YP_826036.1|            LRTAVSMLSLHDAEAQDMSAEANHRKAIRLMSKTATLVTTYDRLRNGKEV
gb|AAL17866.1|AF424980_1    LRSAVSLLGLYDEEADLMDEEANYRKAIRLQAKIPSIVAAFARVRKGLEP
ref|ZP_01859643.1|          LRSAVSLLGLYDEEADVMEEGANFRKAVRLQAKIPTIVTSFARIRSGKEP
ref|NP_244026.1|            LRTAISSLGLYDEEADLMDEAANKRKALKLQAQVSTVVTAFSRIREGKEP
                            **:* * * .:* :       .  ** **. :* ::   .::.:::  *:* * :

gb|ABV27286.1|              VKPDPSLSMAESFLYGLTGEKPHPSSARVFDVCLILHADHELNASTFAAR
RAAC00642                   VQPDPSLSAAANFFYLLRGTKPSEFEEKAFNTALILHADHELNASTFSAR
ref|YP_826036.1|            IPGDPKLSFAANFLYTLTGNRPDEIMERAFDVAMTLHADHELNASTFAAR
gb|AAL17866.1|AF424980_1    VAPRKDLSFAANFLYMLKGKEPEDIAVEAFNKVLVLHADHELNASTFTAR
ref|ZP_01859643.1|          IAPRTDLGFAANFLYMLTGNEPADIEVEAFNKALVLHADHELNASTFTAR
ref|NP_244026.1|            VAPRTDLSFAANFLYMLTGEEPDEIAVDAFNKALVLHADHELNASTFTAR
                            :     .*. * .*:* * * .*          .*:  : ************:**

gb|ABV27286.1|              VIASTLSDMYAAITGAIGALAGSLHGGANQRVLEMLLEIGELDKVEAYVD
RAAC00642                   VTAGTLSDMYSAITSAIGTLKGPLHGGANEQVMRMLLEIGDPSKAITWID
ref|YP_826036.1|            VVAATLSDIYSAITAGIGALKGPLHGGANQDVIKWLLSLGDEEEAVKAVE
gb|AAL17866.1|AF424980_1    VCVATLSDIYSGVTAAIGALKGPLHGGANEAVMKMLTEIGSLENVEPYIR
ref|ZP_01859643.1|          VCVATLSDVYSGVTAAIGALKGPLHGGANEQVMKMLTEIDSVDNVESVIR
ref|NP_244026.1|            VCVATLSDVYSGITAAIGALKGPLHGGANEQVMAMLTEIGDVENVEPYIR
                            *  ..****:*..:*..**:* *.******: *:   *  ...  ...  :

gb|ABV27286.1|              NLFANKKKIMGFGHRVYRTMDPRATVLRKFAKQLGEDVGNTKWYEMAERI
RAAC00642                   EALAQKKKIMGFGHRVYRTEDPRATHLRELSKQAGELKGETKWFEMSQAI
ref|YP_826036.1|            NTLARKVKIPGFGHRVYRTDDPRATHLRVLSEELGKRTGHEKLYRLSQRM
gb|AAL17866.1|AF424980_1    EKLAKKEKIMGFGHRVYRKGDPRAKHLREMSKKLTELTGEPHWYEMSTKI
ref|ZP_01859643.1|          EKLANKEKIMGFGHRVYQQGDPRAKHLKEMSKKLTELRGESKYYEMSTKI
ref|NP_244026.1|            KALDNKQKIMGFGHRVYKNGDPRAKHLREMSKKLTSITGESKWYEMSVKI
                            :  : .* ** *******:    ****. *:  ::::   .    *. :  :.::  :

gb|ABV27286.1|              EQLAFARKKLYPNVDFFSAPVFYTLNIPVDLFTPIFACSRISGWVAHTLE
RAAC00642                   EKHMLEVKGLHANVDFYSASLYYSLGIPTHLYTPIFACSRISGWTAHVLE
ref|YP_826036.1|            EATVKGIKGLNPNVDFYSASAYYSLGIPIDLYTPIFAVSRMSGWTAHVLE
gb|AAL17866.1|AF424980_1    EAIVTGEKGLPPNVDFYSASIYHSLGIDHDLFTPIFAVSRISGWLAHILE
ref|ZP_01859643.1|          EEIVTSEKGLPPNVDFYSASVYHSLGIDHDLFTPIFAVSRVSGWLAHILE
ref|NP_244026.1|            EEIVTNEKGLLPNVDFYSASVYHSLGIKHDLFTPIFAVSRMSGWLAHILE
                            *         * *  .****:** . :::*.*     .*:*****  **:***  ** **
```

FIG. 17B

```
gb|ABV27286.1|              QLRDNRLIRPLALYTG-PEQAEYIPISER
RAAC00642                   QYKNNRLIRPRAEYVG-PTDRKFVPLSER
ref|YP_826036.1|            QYRNNRLIRPRAEYKGNPDGQTWIPIDKR
gb|AAL17866.1|AF424980_1    QYENNRLIRPRADYIG-PGMQKFIPIEQR
ref|ZP_01859643.1|          QYSNNRLIRPRADYIG-PGKQAYVPVEQR
ref|NP_244026.1|            QYSNNRLIRPRAEYVG-PNKRQYVRLEER
                            *  :****** * * *    :: :.:*
```

FIG. 18A

```
ref|YP_001637294.1|     ------------------------------------------------------
ref|ZP_01516643.1|      ------------------------------------------------------
ref|YP_645264.1|        ------------------------------------------------------
RAAC00727               MCFAREVLRGNSDCGIHRNRKRIGFVLPVYSFSDTRPEFLLGIPGCPKAPQAGAPSCPVR
ref|YP_146876.1|        ------------------------------------------------------
ref|YP_001125008.1|     ------------------------------------------------------ ref|YP_001637294.1|     -------------------WNGFYGPNAGYLIELYERYCADPNSVDEATRAFFAQWAPPSD
ref|ZP_01516643.1|      -------------------WNGFYGPNAGYLLELYERYCADPNSVDEATRAFFAQWTPPDE
ref|YP_645264.1|        -------------------QFYGPNLGYVLELYERYREDPGSVDEETRRFFERWSPP-R
RAAC00727               VEEGFTMANEQPGSVQTFWHQFSGPNLAYLLEQYEQYLADPNAVPEDVRSLFAQYGDPAQ
ref|YP_146876.1|        -------------------WSQFYGPNLGYVIEMYEQYLDDPNSIDPELKQLFEQWGAPVL
ref|YP_001125008.1|     ---------------------------DPDSVDPELKQLFEQWGAPVV
                                                   **.::     : :* ::    * ref|YP_001637294.1|     SAAPAGEAGQP------------PLDVTRIVGAARLIRYIREL---------------G
ref|ZP_01516643.1|      ITSSETRDGQP------------PLDVTRIVGAARLIRYIREL---------------G
ref|YP_645264.1|        IEVDGRVAGAA------------LEAEKYVGAAKYIRSIRDF---------------G
RAAC00727               AVSASPIETQPVFGPQVSAL--SPRTLEAAAKAHQLAQAIRAN---------------G
ref|YP_146876.1|        EEPVSPADDETAKTHQTFRLPETPTIFSKLVAAVKLADSIRHY---------------G
ref|YP_001125008.1|     EEPVSPADPEATQTHQTFRLPETPTVFSKLVAAVKLADSIRHY---------------G
                                      . * :      **                             * ref|YP_001637294.1|     HLAARIDPLGSDPPGDPGLELATHGVTQADLAALPAHIVRGPIATQVRNAAEGVERLRQA
ref|ZP_01516643.1|      HLAARIDPLGSDPPGDPGLELATHGVTQADLAALPAHIVRGPIASQVRNAAEGVERLRQA
ref|YP_645264.1|        HSAARLDPLGGEPPGDPALDPAFHGITEEDLERMPSSIVGGPIAERTSNAREAVEELKRI
RAAC00727               HLAADTDPLFA-PEGSPELEASTYGLVEADLASLPASVVGGPIAQTAPTALAAIEALRKA
ref|YP_146876.1|        HLVADTNPLVKKEKKLRRLELDEYDLTEEDLKRIPVAFLCPHAPAHVKNGWDAILHLRKI
ref|YP_001125008.1|     HLAADTNPIVKKEKKLRRLELDEYDLTEEDLKRIPVAFLCPHAPAHVKNGWDAILHLRKI
                        * .*  :*:          *:   :.:.: ** :*   .:    .  . .. .: *::

ref|YP_001637294.1|     YSGSIGYETDQIQDYL-ERAWIREAAEDRRFFGGLDADRQRELLDRLTEVECFERFLHKT
ref|ZP_01516643.1|      YSGSIGYETDQIQDYR-ERAWIREAAEDRRFFGGLDADRQRELLDRLTEVETFERFLHKT
ref|YP_645264.1|        YCKTTGYDFGHIAHLPEERFWLRDAVESEQFYQRLEGEAARRLLRRLTRVDTFEKFLHRT
RAAC00727               YCSDLGYEFAHLSSRE-ERAWFEDQIENRRFHQPLTLDEAKALYELLARAQLFERFMHKR
ref|YP_146876.1|        YTDKIAFEFSQVHNLE-ERNWLIQQIESGAYYPSLANKERVALLRRLTEVEGFEKFIHRT
ref|YP_001125008.1|     YTDKIAFEFSQVHNLE-ERNWLIQQIESGAYYPSLANKERVALLRRLTEVEGFEKFIHRT
                        *   .::  ::    **  *:   :. *   *    *:...: **:*:*:

ref|YP_001637294.1|     FPGQKRFSIEGCDMLIPMIDAIIRNAAVNGTKEVVIGMAHRGRLNVLAHILGKPYSMILT
ref|ZP_01516643.1|      FPGQKRFSIEGCDMLIPMIDAIIRNAAASGTKEVVIGMAHRGRLNVLAHILGKPYSLILT
ref|YP_645264.1|        FLGQKRFSVEGNDMVVPMLDRLIRHAADAGTPEVVMGMAHRGRLNVLAHVLNKPYAKIFG
RAAC00727               FVGQKRFSVEGVDALVPMVDALAKMAVDAGFDHVFIGMAHRGRLNILAHVLKKPYERIFS
ref|YP_146876.1|        YVGQKRFSIEGLDSMVPLLDELVRQAIEHEIDAVNIGMAHRGRLNVLAHVLGKPYEMIFA
ref|YP_001125008.1|     YVGQKRFSIEGLDSMVPLLDELVRQAIEHEIDAVNIGMAHRGRLNVLAHVLGKPYEMIFA
                        : ******:**  * ::*::*  : :  *           * :**********:*** ***   *:
```

FIG. 18B

```
ref|YP_001637294.1|    EFHSPDYTKDTYE---------GWTGDVKYHLG-ARKAYRESG--IAEMPITLAPNPSHL
ref|ZP_01516643.1|     EFHSPDYTKDTYE---------GWSGDVKYHLG-ARKAYRESG--IAEMPITLAPNPSHL
ref|YP_645264.1|       EFQQPERGEQSSVSEMSGE---GWVGDVKYHLG-VRNFHLEEGQEDAKVLINLAPNPSHL
RAAC00727              EFHAGNGMASDEE---LAEYMLGWGGDVKYHMGWTRTFETPNG---HKARYVLSNNPSHL
ref|YP_146876.1|       EFQHAESKNFIPS-EGSVAITYGWTGDVKYHLGAARRLRNQSA---HTMRITLANNPSHL
ref|YP_001125008.1|    EFQHAESKNFIPS-EGAVAITYGWTGDVKYHLGAARRLRNKSA---HTMRITLANNPSHL
                       :  :              ******:*  .*       ..      *: ***** ref|YP_001637294.1|    EFINPVVEGRARAAQEHRNRPGFPEEDEKESLAILIHGDAAFPGQGIVAETLNLSRLKGY
ref|ZP_01516643.1|     EFINPVVEGRARAAQERRNRPGFPEEDEKESLAILIHGDAAFPGQGIVAETLNLSRLKGY
ref|YP_645264.1|       EHVNPVVSGMTRAAQERRDEAGPPRQDVDAALSIVLHGDAAFPGEGVAAETLNLYRLPGY
RAAC00727              EFVDPVVEGMTRAAQDDRTRPGQPIQDVHKAFPILVHGDAAFTGEGVVAETLNFSKIPGY
ref|YP_146876.1|       EVVNPVVLGYTRAAQEDRTKPGVPVQNTDASFAILIHGDAAFPGQGIVAETLNLSQLRGY
ref|YP_001125008.1|    EVVNPVVLGYTRAAQEDRTKPGVPEQKVDASFAILIHGDAAFPGQGVVAETLNLSQLRGY
                       * ::***  *  :****:  * ..*  *  :. . .::.*::*****.*:*:.*****:  ::  **

ref|YP_001637294.1|    HTGGTIHIIINNQIGFTTDSNDSRSTLYASDLARGLEIPVVHVNADDVEACIAAARMASA
ref|ZP_01516643.1|     HIGGTIHIIINNQIGFTTDSSDSRSTLYASDLARGLEIPVVHVNADDVEACIAAARMASA
ref|YP_645264.1|       RVGGTIHIITNNQLGFTTEKEDARSTTYASDLAKGYEIPVVHVNADDPEACLAAVSLAYA
RAAC00727              YTGGTVHIIANNHLGFTADPEQGRSTRYASDIAKGYDLPVVHVSADNPEACLRAVRLAFL
ref|YP_146876.1|       TTGGTIHIIANNMIGFTTESYDSRSTTYASDMAKGFEVPIVHVNADDPEACLAAACLAFA
ref|YP_001125008.1|    TTGGAIHIIANNMIGFTTESYDSRSTTYASDMAKGFEVPIVHVNADDPEACLAAASLAFA
                       :*  :*::    :.* **:*:*   ::*:*.: ***  *.  :* ref|YP_001637294.1|    YREKFQKDFLIDLVGYRRWGHNEGDEPEFTQPKMYERIRNHPTVREIWARELERRGIITR
ref|ZP_01516643.1|     YREKFQKDFLIDLVGYRRWGHNEGDEPEFTQPKMYERIRNHPTVREIWARELERRGIITR
ref|YP_645264.1|       YRQRFHKDFMIDLIGYRRYGHNEGDEPVYTQPVMYEKIRNHPTVREIWARTLEERGVISE
RAAC00727              YRETFQKDIVIDLVGYRRWGHNESDDPAMTQPVMYAKIASHPTVMEIYANELVARGAFTA
ref|YP_146876.1|       YRQRFKKDFVIDLIGYRRFGHNEMDEPMATNPTMYAIINQHPTVRKLYAQKLMEKGIITE
ref|YP_001125008.1|    YRQRFKKDFVIDLIGYRRFGHNEMDEPMATNPLMYSIIHQHPTVRQLYAQKLIDKGIIAE
                       **: *:**::***:****:**** *:*  *:* ** * .**** :::*. *  :* ::

ref|YP_001637294.1|    EEAQARVDAVMNRLQQAFEKVRERQRLAASLPPAPPP-PVQPLRRPPIFARPVSAKTLIE
ref|ZP_01516643.1|     EEAQARVNAVMNKLQQAFDKVRERQRLAAELPAPAPAPSLPPRRPPIFARPVSAKTLIE
ref|YP_645264.1|       GEAEKMAEEMFARMQEIHKNPSE-QLTEEDF---DTEEPHTPLVDIPETA--VEASRLEA
RAAC00727              ADLQKIDQAIDEELLQAYKKYPE----------IHTPAAITDFSEPTEDAKPVPLEELKE
ref|YP_146876.1|       REVDEMEQEVAERLKIAYERVPK----NEDELDFIMDPPKPVVDRLPEVKTSVAKDVLHR
ref|YP_001125008.1|    REVEEMEQEVAERLKIAYERVPK----NEEELDFIMDPPKPVVDRLPEVKTGVAKDVLHR
                         :  :       :  : ..:   ...                  .      *   . * ref|YP_001637294.1|    LNEALLDRPEGFTVHPKLERTLQRRRQAIFEESGIDWGHAEALAFASILADGTPIRLTGQ
ref|ZP_01516643.1|     LNEALLDRPEGFTVHPKLERMLQRRRQAIYEENGIDWGHAEALAFASILADGTPIRLTGQ
ref|YP_645264.1|       LNRAMLERPEGFSPNRKLERLFQKNR-GSLER--IDWAHAEALAFASLLEDGIPIRLTGQ
RAAC00727              INRALLETPPDFTVYPKLKRILERRR-DALDGGDIDWAHAEALAFGTILRSGTPIRMSGQ
ref|YP_146876.1|       VNEELLQFPDGFNVFNKLERILKRRSGVFAQNGKVDWAHAEILAFATILQDGVPIRLTGQ
ref|YP_001125008.1|    INEELLEFPADFHVFNKLERILKRRSNVFAQNGKIDWAHAETLAFATILQDGVPIRLTGQ
                       :*. :*: * .*    **:* :::.       :   :**.*** ***.::* .* ***::**

ref|YP_001637294.1|    DSERGTFSHRHAVLHDVVTGERFIPLHHIPQARASFAVYNSPLSEASVLGFEYGYSCHAP
ref|ZP_01516643.1|     DSERGTFSHRHAVLHDVVTGERFIPLHAIPQARASFAVYNSPLSEASVLGFEYGYSCHAP
ref|YP_645264.1|       DSERGTFSQRHAVLHDEKTGEEYVPLQNIPQARASFDIHNSPLSEMAVMGFEYGYSVNAP
RAAC00727              DSERGTFGQRHLVLHDANTNARYAPLQHLPGAKASFVVYNSPLSETAVIGFEYGYSVEAK
ref|YP_146876.1|       DSQRGTFAQRHLVLHDVKTGEEYVPLHHISGAKASFVVYNSPLTEAAVLGYEYGYNVYAP
ref|YP_001125008.1|    DSQRGTFAQRHLVLHDVKTGKEYVPLHHISGAKASFVVYNSPLTEAAVLGYEYGYNVYAP
                       **:****.:** ****  *.  .: **: :. *:*** ::****:* :*:*:****. *
```

FIG. 18C

```
ref|YP_001637294.1|    DTLVLWEAQFGDFANGAQVIIDQFIVSGHAKWGQNPSLVMLLPHGYEGQGPEHSSARLER
ref|ZP_01516643.1|     DTLVLWEAQFGDFANGAQVIIDQFIVSGHAKWGQNPSLVMLLPHGYEGQGPEHSSARLER
ref|YP_645264.1|       DALTLWEAQYGDFANVGQPIIDQFIVSGQAKWGQVSNLVLLLPHGYEGQGPEHSSARLER
RAAC00727              DALVLWEAQYGDFANVGQPLFDNFIVAARSKWGETSGLVLLLPHGFEGQAHEHSSGRVER
ref|YP_146876.1|       ETLVLWEAQFGDFANMAQVMFDQFISSGRAKWGQKSGLVMLLPHGYEGQGPEHSSGRVER
ref|YP_001125008.1|    ETLVLWEAQFGDFANMAQVMFDQFISSGRAKWGQKSGLVMLLPHGYEGQGPEHSSGRIER
                       ::*.*****:*****  .*  ::*:**  :.::***:  ..**:****:***. ****.*:**

ref|YP_001637294.1|    FLQLAANDNIRVANCTTAAQYFHLLRYQAASLYADP-KPLIILTPKSLLRHPRSSSSLRD
ref|ZP_01516643.1|     FLQLAANDNIRIANCTTAAQYFHLLRYQATSLYADP-KPLIILTPKSLLRHPRSSSSLRD
ref|YP_645264.1|       FLQLAAGENIRVANPTTAAQYFHLLRAQAI-LKDHK-RPLVLMTPKSLLRHPMAASGLQE
RAAC00727              FLQLAARNNIVVANVTTSAQYFHLLRRQAARLKNP--RPLVIMTPKSLLRNPLAASKPED
ref|YP_146876.1|       FLQLAAENNWTVANLSTAAQYFHILRRQAALLTREEVRPLIIMTPKSLLRHPLAASDAEV
ref|YP_001125008.1|    FLQLAAENNWTVANLSTAAQYFHILRRQAALLKKEEVRPLVLMTPKSLLRHPLASSEAEA
                       ****** :*  :** :*:*****:** **   *     :**:::*******:*  ::*   .

ref|YP_001637294.1|    LTDHRFQPVLGLGAEAPAPEGVTRLILCSGKVAIDLLS--SAEWE---KTAGRVDVLRLE
ref|ZP_01516643.1|     LTDLRFQPVLGLGAEAPLPEGVTRLILCSGKVAIDLIS--SAEWE---KTAGRADLLRLE
ref|YP_645264.1|       LAEGRFHPVLDDEEAREGAGSVERLILCSGKIYTELVG---SDFR---EEAEEVAIARVE
RAAC00727              LTNGRFQPVLHFAKTGEGAQAVRRLILSSGKVGVDLAAEMSKRGE---EACAHVATARVE
ref|YP_146876.1|       FVDGAFSPVLEQPGLGADAGKVERIVFGTGKLMIDLAEQIGKMES---LDWLHI--VRIE
ref|YP_001125008.1|    LVQGAFSPVLEQPGLGVDASKVERIVFGTGKLMIDLAEQIGKMDG---LDWLHV--VRVE
                       :.:  *  ***       . * *::: :**: :*          .        *:* ref|YP_001637294.1|    LLYPFPAEELRMAMQRYPNLQEVVWLQEEPQNMGAWSFVWPRLQQLLPEGVTLRYVGRAE
ref|ZP_01516643.1|     LLYPFPAEEVQAAIRRYPNLREVVWLQEEPQNMGAWTFVWPRLQTLLPTGVTLRYVGRAE
ref|YP_645264.1|       LLYPFPEGQIREVIAGYPNLRELVWVQEEPKNMGAWFFMEPRLREITGGELPIRYVGKPA
RAAC00727              QLYPFPADRVKDVIASYPNLQEVVWLQEEPENQGPWNFMRPRLQELLPASVKLRYIGRPE
ref|YP_146876.1|       ELYPFPEEAVKDIIARYPNVKELVWVQEEPKNMGAWLYMEPRLRALAPEGVDVSYIGRRR
ref|YP_001125008.1|    ELYPFPEEAVQAIIARYPNVKELVWVQEEPKNMGAWMYMEPRLRAIAPEGVDVSYIGRRR
                       *****   ::  :  ***:*:**:****:* *.*   ::  ***:      : : *:*:

ref|YP_001637294.1|    SASPAEGLHSIHVREQARILREAVAD---
ref|ZP_01516643.1|     SSSPAEGLHSIHVREQARILREAVAN---
ref|YP_645264.1|       RPSPAQGSVSFHRREHAQIVREAFRRDS-
RAAC00727              QGFVAEGSPDVHNRVQAEILAQALANDNH
ref|YP_146876.1|       RASPAEGDPVVHRKEQERIIRCAL-----
ref|YP_001125008.1|    RASPAEGDPVVHRKEQERIIRCAL-----
                        *:*    .*  : :  .*:   *.
```

FIG. 19A

```
ref|YP_001125365.1|    ---------------------------------------------------------QTKTD
ref|YP_147249.1|       -----------------------------------------------------------KMD
ref|NP_244828.1|       --------------------------------------------------------QNKTD
ref|YP_895448.1|       -----------------------------------------------------------KTD
ref|ZP_01695431.1|     -----------------------------------------------------------KTD
RAAC00729              MIYTLYGLSKSVERCGNRLISARGRSARRRMSTVWFAGRIKVRPHLHKDGIDMDGKTRSD
                                                                                  : * ref|YP_001125365.1|    VILIGAGIMSATLGTLLKELAPEWDITVFERLEEAGVESSNEWNNAGTGHAALCELNYTV
ref|YP_147249.1|       VILIGAGIMSATLGTLLKELAPEWDIVVFERLEEAGAESSNEWNNAGTGHAALCELNYTV
ref|NP_244828.1|       VILIGAGIMSATLGSLLKELKPEWEIKVFEKLANAGEESSNEWNNAGTGHAALCELNYTA
ref|YP_895448.1|       VILIGAGIMSATLGSLLKELAPEWEIKVFEKLASAGEESSNEWNNAGTGHSALCELNYTS
ref|ZP_01695431.1|     VILIGAGIMSATLGTLLKELTPDWEITVYEKLAKPAEESSNEWNNAGTGHSALCELNYTP
RAAC00729              VALIGGGIMSATLGTLFRQLAPDWTITVFERLDEVAVESSNEWNNAGTGHSALCELNYTV
                       * *.******:*::* *:*  *  *:*:*  .  . ***************:****** ref|YP_001125365.1|    EKPDGSIDISKAIKINEQFYVSLQFWAYLVNSGVLRDPKEFIRPLPHMSFVQGEDNVAFL
ref|YP_147249.1|       EKADGSIDIGKAIKINEQFYVSLQFWAYLVNSGILRDPKDFVRPLPHMSFVQGEDNVAFL
ref|NP_244828.1|       EKSDGTIDISKAVKINEQFQISRQFWAYLVSQNLISNPQDFIMPIPHMSLVQGEDNVAYL
ref|YP_895448.1|       EKSDGSIDISKAVKVNEQFQLSRQFWAYLVKSKLIRNPQDFIMPLPHMSLVQGEKNVEFL
ref|ZP_01695431.1|     EKPDGSIDITKAVNVNEQFQLSRQFWSYLVSKGLIHNPQDFIRPIPHMSLVEGEANVAFL
RAAC00729              EQPDGSIDISKAIQVNEQFLVSRQFWSFLVRQGIIEHPRDFIVPVPHMSFVQGETNVAFL
                       *:.:* :::**  :* *:.. . :: .*::*: *:****:*:   :* ref|YP_001125365.1|    KKRYETMVNNPLFKGMEFSDDPKKLAEWIPLMMENRVVNEPIAATRIESGTDVNFGALTR
ref|YP_147249.1|       KKRHETMAANPLFKGMEFTDDPKKLAEWVPLMMEGRVVDEPIAATRIESGTDVNFGALTR
ref|NP_244828.1|       KKRFKALSNIPLFEGMEFSNDPEKLKEWIPLVMEGRTSNEPIAATKIDSGTDVNFGALTR
ref|YP_895448.1|       KNRFEALSKNPLFQGMEFSDAPETLKKWLPLIMEGRTSNEPMAATKIDSGTDVNFGALTR
ref|ZP_01695431.1|     KKRFKALSAHPLFEGMTFSDDPEQLKEWIPLVMEGRTSNEPIAATKSDAGTDVNFGALTR
RAAC00729              KKRHQLLSQHPLFQGMEYSEDPERLREWIPLMMKDRKLDRPIAATWIASGTDVNFGALTR
                       *:*.: :    *:  :::   *:  *   *:*:**:*:.*  :.*:*    :********* ref|YP_001125365.1|    KLFEHLKRKNVEIHYRHHVDDIKRTSDGLWELKVRDLDSGAVERHVAKFVFIGAGGGSLH
ref|YP_147249.1|       QLFEHLKRKNVEIRYRHHVEDIKRTSDGLWELKVRNLDTGTVELHAAKFVFIGAGGGSLH
ref|NP_244828.1|       MLFEHLKEQNVEVHYKHSVKDIKRTSDGSWSVKVQEIESGTIEYHTANFVFIGGGGGSLP
ref|YP_895448.1|       MLFDYLQTKNVELNYKHSVENIKRTKNGLWEVKVHDINSGKIEHHTAKFVFIGGGGGSLP
ref|ZP_01695431.1|     ILFDHLERQDVEINYKHAVQDIQRTPEGNWEVKVHDIEHNRIEYHTAKFIFIGAGGGSLP
RAAC00729              MLFQYLEREGVDVQCGKEVQDLKRTRDGMWQLRVRDVKTGATYEHVSKFVFVGAGGWSLL
                        **::*: :.*::.   : *.:::**  :* *.::*::.      *.::*:*:*.** **

ref|YP_001125365.1|    LLQKSGIPEGRGIGGFPVSGLFMVCNNPDVVEQHHAKVYGKAKVGAPPMSVPHLDTRFIN
ref|YP_147249.1|       LLQKSGIPEGKGIGGFPVSGLFMVCNNPEVVEQHHAKVYGKAKVGAPPMSVPHLDTRFID
ref|NP_244828.1|       LLQKTGIPESKNIGGFPVSGLFMVCNNPEVVEQHHAKVYGKAKVGAPPMSVPHLDTRYID
ref|YP_895448.1|       LLQKTGIPESKHIGGFPVSGLFMVCKNQKVVEQHHAKVYGKAKVGAPPMSVPHLDTRYID
ref|ZP_01695431.1|     LLQKTGIPESKHIGGFPVSGLFMVCNNPEVINRHHAKVYGKAKVGAPPMSVPHLDTRYID
RAAC00729              LLQKSGIDEGKGIGGFPVSGLFMVCENPEIVRQHRAKVYGKAPVGAPPMSVPHLDSRVIG
                       ****:** *.: *************:* .::.:*:****** **************:* *.

ref|YP_001125365.1|    NQKMLLFGPFAGFSPKFLKNGSMLDLFTSVKPHNLLTMLAAGVKNMALTNYLIQQVMLSK
ref|YP_147249.1|       NQKMLLFGPFAGFSPKFLKNGSMLDLFTSIKPHNVLTILAAGVKNMSLTNYLIQQVLLSK
ref|NP_244828.1|       NKKSLLFGPFAGFSPKFLKTGSNFDLIGSVKPYNVFTMLAAGAKEMSLTKYLIQQVMLSK
ref|YP_895448.1|       NKKALLFGPFAGFSPKFLKTGSNLDLIGSVKPNNVLTMLAAGVKEMGLTKYLIQQVMLSH
ref|ZP_01695431.1|     HKKCLLFGPFAGFSPKFLKTGSNLDLIGSVKPNNVVTMLASGAKNVPLVKYLIGQLLLSD
RAAC00729              GREYVLFGPFAGFSPRFLKTGSMLDLLKSVKLHNLSTLLAAGAKNASLTLYLIRQLMLTK
                        ::  :**********:***.**  **. **: *:*  *: *:**:*.*:  *. *** *:::*:.
```

FIG. 19B

```
ref|YP_001125365.1|    EQRMEELREFVPTAKSEEWDVIVAGQRVQVIKDTEAGGKGTLQFGTEVVHAADGSIAALL
ref|YP_147249.1|       EQRMQELREFVPTAKSDEWDIVVAGQRVQVIKDTESGGKGTLQFGTEVVHAADGSIAALL
ref|NP_244828.1|       EKRMAELREFMPNAKSEDWDIVVAGQRVQVIKDTEAGGKGTLQFGTEVVSSADGSIAALL
ref|YP_895448.1|       EKRMEELREFIPNAKSEDWDIVVAGQRVQVIKDTDAGGKGTLQFGTEVVSAADGSIAALL
ref|ZP_01695431.1|     EKRLETLQEFIPDARLEDWDVVVAGQRVQVIKDTEAGGKGTLQFGTEVVTAADGSVAALL
RAAC00729              KQRMDELREFVPTARDEDWRLVVAGQRVQVIKRRP---RGELQFGTEVVSARDGSIAALL
                       ::*:   *:**:* *:  ::* ::**********       :* ***** : *:**** ref|YP_001125365.1|    GASPGASTAVHVMLEVITKCFPERMKEWEPKVREMIPSYGVSLMKNERLLHDVQAATAEM
ref|YP_147249.1|       GASPGASTAVHVMLEVMEKCFPERMNEWRAKVKEMIPSYGESLMKNEALLRQVQASTAEA
ref|NP_244828.1|       GASPGASTAVHVMLEVLEKCFPHHMLEWQPKIKEMIPSYGVSLAENRELFQEIHQSTAEA
ref|YP_895448.1|       GASPGASTAVHVMLEVLEKCFPSRMVEWEGKIKEMIPSYGISLTENPRLFQDLHTSTGRT
ref|ZP_01695431.1|     GASPGASTAVHVMLEVIEKCFPDRKNAWAPKIKEMIPSYGVRLAENPELLHQIHAETAET
RAAC00729              GASPGASVVVSIMLEVIRKCFPDRLPEWENKIREMIPSYGVTLRHRPDLMRSIQAETAEV
                       *******..* ;****: **** :    *  *;:******  *  .. *::.::  *..

ref|YP_001125365.1|    LGL---------
ref|YP_147249.1|       LGLN--------
ref|NP_244828.1|       LGLSEKE-----
ref|YP_895448.1|       LGLNEKE-----
ref|ZP_01695431.1|     LGLTEKE-----
RAAC00729              LGLHRMEARTDA
                       ***
```

FIG. 20A

```
sp|P16468|MAOX_BACST    -----AAMNITIRLQFEKDIVSFSDIAAAIGKAGGDIVGIDVISSSKVHTVRDITVSALD
ref|YP_147293.1|        -----AAMNITIRLQFEKDIVSFSDIAAAIGKAGGDIVGIDVISSSKVHTVRDITVSALD
ref|YP_001125416.1|     ------------------------------------------------------------
ref|YP_075148.1|        -----ASMRIIVRLEIENTGSIFSYIATAIGASGGDIVAVDLIQSRRDVVVRDITIAVEN
RAAC00730               MEFQRSGISLIYRLEIANKGNTFAKVASLVGNAGGDIAAVDVIRVTQDVVVRDVTINVAN
ref|YP_643888.1|        --------SMTLRVEFPHRAGALGRILTTIGDAGGMVGAIDIVRMGQERSIRDITVNARD sp|P16468|MAOX_BACST    TKQCDLIIEALKKIRGVKIVNVSDRTFLMHIGGKIETNSKIPVKTRDDLSRVYTPGVARV
ref|YP_147293.1|        TKQCDLIIEALKKIQGVKIINVSDRTFLMHIGGKIETNSKIPVKTRDDLSRVYTPGVARV
ref|YP_001125416.1|     ------IIEALKKIRGVKIVNVSDRTFLMHIGGKIETNSKIPVKTRDDLSRVYTPGVARV
ref|YP_075148.1|        RAHGDRIVQALAALPGVKVVNVSDRIFLAHLGGKIEVKPRVQVKTRDDLSVVYTPGVADV
RAAC00730               REHGRQIAELLDAEPGIHVVAVSDRTFLVHLGGKLEVVPKIQVKNREDLSRVYTPHVARV
ref|YP_643888.1|        SEHGQRIVRAVGALPEVRVVNVSDRTFLLHLGGKIEVHSKIPVRTRDDLSMAYTPGVARV
                          *  . :     :::: **  *:***:*.  .:: *:.*:*  .* ** * sp|P16468|MAOX_BACST    CTAIAEDPRKAYSLTIKRNTVAVVSDGTAVLGLGDIGPYAAMPVMEGKAMLFKEFAGVDA
ref|YP_147293.1|        CTAIAEDPRKAYSLTIKRNTVAVVSDGTAVLGLGDIGPYAAMPVMEGKAMLFKEFAGVDA
ref|YP_001125416.1|     CTAIAEDPRKAYSLTIKRNTVAVVSDGTAVLGLGDIGPYAAMPVMEGKAMLFKQFAGVDA
ref|YP_075148.1|        CRAIAEDPAKAFTLTIKRNTVAVVTDGTAVLGLGNIGPAAALPVMEGKAMLFKQFAGVDA
RAAC00730               CEAIHEDPSKAFQLTIKRNTVAVVSDGTAVLGLGDIGPYAAMPVMEGKAMLFKQFAGVDA
ref|YP_643888.1|        CRAIAQEPERAFNLTIKRNSVAVVTDGTAVLGLGDIGPYAAMPVMEGKAMLFKEFAGVDA
                        * **  ::*  :*:  *****:**.***:* .*******:**** sp|P16468|MAOX_BACST    FPICLDTKDTEEIIQIVKAIAPAFGGINLEDISAPRCFEIEKRLKEELDIPVFHDDQHGT
ref|YP_147293.1|        FPICLNTKDTEEIIQIVKAIAPAFGGINLEDISAPRCFEIEKRLKEELDIPVFHDDQHGT
ref|YP_001125416.1|     FPVCLDTKDTEEIIQIVKAIAPAFGGINLEDISAPRCFEIEARLKEELDIPVFHDDQHGT
ref|YP_075148.1|        FPICLDTTDPDEIVRIVKAIAPAFGGINLEDISSPRCFEIEERLKEELDIPVFHDDQHGT
RAAC00730               FPICLDTKDPDEIVETVKRIAPAFGGINLEDISSPRCFYIEERLKQELDIPVFHDDQHGT
ref|YP_643888.1|        FPVCLDTKDPEEIVRTVKYVAPAFGGINLEDISAPRCFEIEERLKQELDIPVFHDDQHGT
                        ::*.*.::.   :***********:   *:******** sp|P16468|MAOX_BACST    AVVLLAGLLNALKIVDKKLEDIKVVLTGIGAAGIACTKILLAAGVRNIIGVDRHGAIHRD
ref|YP_147293.1|        AVVLLAGLLNALKIVDKKLEDIKVVLTGIGAAGIACTKILLAAGVRNIIGVDRHGAIHRD
ref|YP_001125416.1|     AVVLLAGLLNALKIVDKKLEDIKVVLTGIGAAGIACTKILLAAGVRNIIGVDRYGAIHRD
ref|YP_075148.1|        AVVVLAGLMNAARVVGKELADLRVVVCGIGAAGVAISKMLMAAGITNIVGVDRVGIIERG
RAAC00730               AVVMLAGLMNAAKLVGKKLQDLKVVIVGIGAAGVACTKMLLSAGVKNIIGVTLEGILHRG
ref|YP_643888.1|        AVVVLAALINALRIVGKRMEELKVVCGVGAAGVACAKILLAAGVKNIVGCDRYGVVYRG
                        ***:**.*:** ::*.*.:  :::**:  *:****:*  :*:*::*: **:*    *  : *.

sp|P16468|MAOX_BACST    ETYENPYWQEYAQLTNPDNLKGSLSDVIAGADVFIGVSAPGILKVEDVKKMARDPIVFAM
ref|YP_147293.1|        ETYENPYWQEYAQITNPDNLKGSLSDVIAGADVFIGVSAPGILKVEDVKKMARDPIVFAM
ref|YP_001125416.1|     ETYENPYWQEYAQITNPYNLKGSLSDVIVGADVFIGVSAPGILKVEDVKKMARDPIVFAM
ref|YP_075148.1|        KTYENPMWQWYAEHTNPENRHGTLDDAIEGADAFIGVSAPNVLKVEHVKKMAKDPIVFAM
RAAC00730               KQYDNEIWNWYKEHTNPDNITGTLDDAIVGADVFIGVSGPGVLTVDHIKKMAPDPIVFAM
ref|YP_643888.1|        RGDADTSRGWFAENTNPENIRGTLADAIRGADVFIGVSAPDVLTVEHIESMADEPIVFAM
                        .  :    :   : *** *  *:* *.* * *** .*.:*.*.:::.  :**** sp|P16468|MAOX_BACST    ANPIPEIDPELAEPYVRVMATGRSDYPNQINNVLCFPGIFRGALDCRAREINEEMKLAAA
ref|YP_147293.1|        ANPIPEIDPELAEPYVRVMATGRSDYPNQINNVLCFPGIFRGALDCRAREINEEMKLAAA
ref|YP_001125416.1|     ANPVPEIDPELAEPYVRVMATGRSDYPNQINNVLCFPGIFRGALDCRAKEINEEMKLAAA
ref|YP_075148.1|        ANPVPEIDPDEAAPYVAVMATGRSDYPNQVNNLLCFPGIFRGALNCRARQINEAMKLAAA
RAAC00730               ANPTPEIEPELAAPHVRVLATGRSDYPNQINNLLCFPGMFKGALAARASTINEEMKLAAA
ref|YP_643888.1|        ANPDPEIRPEIAYGHARIIATGRSDYPNQINNVLCFPGVFRGALDIRAREINEEMKLAAA
                        *** *** *: *  :. ::**********:**:*****:***  **   *** ******
```

FIG. 20B

```
sp|P16468|MAOX_BACST    KAIASVVTEDELNETYIIPSVFN------------------------------
ref|YP_147293.1|        KAIASVVTEDELNETYIIPSVFN------------------------------
ref|YP_001125416.1|     KAIASVVTEDELNETYIIPSVFN------------------------------
ref|YP_075148.1|        RAIASVVSDEELHAEYIIPSVFN------------------------------
RAAC00730               QAIASIIRENELREDYIIPSVFNQAVVQRVADAVADAARRTGVARREVMPKDNY
ref|YP_643888.1|        RAIAGVIPEESLSEDYIIPSVFD------------------------------
                        :***.::   ::.*    *******:
```

FIG. 21A

```
ref|ZP_01696337.1|    ------------------------GEALLKTIQNIRSLAQKARETGDEAFYLQLKKEI
ref|ZP_02171753.1|    ------------------------GEALFNEVEEIREMTKALRKSYDEANEKELKKRI
RAAC00735             MANDAPLHRDIRVLGDLLGEVLVEQCGRRVFDHVESIRLAAKAFRADPSPETRAALQAAV
ref|YP_001546997.1|   ------------------------QDGVSAFELEEDVRQRTKQRRSDGTLQETQTLTELI
ref|YP_001277075.1|   ------------------------QAGEEAFRLVEQLRTLGKELRNGEPDRADASLRALA
ref|YP_284976.1|      -SKDEPLRTDIRLLGRILGDTVREQEGESVFDIVERVRQTAVRFARDGDPAARDELAALL
                                              *   :    :  :*                 * ref|ZP_01696337.1|    TDLNPPERQEVIRAFSTYLQLFNITEQNFRIKRRREYQSEDTDQVQPRSLEDGIETLRKE
ref|ZP_02171753.1|    ENLKSPMRQQVIRAFAIYFHLVNIAEQHHRIRRSRQYRMKRGENIQPSSIEAAIVNIQKE
RAAC00735             SAVEPEHRNDVIHAFSVYFQLVNLAEQNHRLRRHRDYD--RSQQVLRGSFRETMRTLADR
ref|YP_001546997.1|   SQLPVAQLMGLIKAFTHYFGLVNLAESVERLRVLAERDRQNGDAPRSESVELALQELRDR
ref|YP_001277075.1|   SQMTVTDVQTVIKAFNAYFLLVNLAEQMQRVWILRDREQASPTAPRTESIAAAIAEIHAH
ref|YP_284976.1|      DPLPGDTTQAVVRAFSYFLQLANIAEDEHHIRRRRAHDLAGSPP-REGSLIFALDALSTA
                           :  :::** :: * *::*. ::          *.    :   :

ref|ZP_01696337.1|    KVPAEMVAELLNSLSLELIITAHPTEATRRTILQIHKRIADLLKALEYAN-TRYEKKVIE
ref|ZP_02171753.1|    KYPETVIQQVLDDSSIELIMTAHPTEATKRTILEIQKRISYILEQFDNPALTEKEREDHE
RAAC00735             GMTADDIESLLREVGIELVLTAHPTEALRRTVLDKHTKIAAFLEDMDDPRKTPRELDVLR
ref|YP_001546997.1|   GITAQQVQDLLDHAEIRPVFTAHPTEAKRRTTLKKHHRIAGAARQLTADTTFQRQRERLL
ref|YP_001277075.1|   NVSAVTVQEWLETARIQPVFTAHPTEARRRTALEKVRRLATLL-DRRSGGLQGFELEENT
ref|YP_284976.1|      AVSPEAIADFFAHVVAPVLTAHPTEVQRQSLIRNHRDLAHLLDQRERLQMTPEEEAEND
                       .  :  . :    : ::******. ::: :        ::          :

ref|ZP_01696337.1|    ETILNEITILWQSSEIREKKPSVLDEVKNGLYYFDNVLFDVLPRIHEDLEDYLHESYG-Q
ref|ZP_02171753.1|    ESLINEVTALWHTDELRFKKPTVIDEVKNGLYYFDTTLFDVLPAVHQEIEEQLERYYPDQ
RAAC00735             ERIRTEIVALWQTRSVRKQRITVLDEVRNGLYFLDQILFDVLPRVHQKLEQAVEEQFGRQ
ref|YP_001546997.1|   ESIREEVISLWQSDEVRIIKPTVIDEVKNNLYYFEESLFDMIPQLYRDTEASLRQIYPEH
ref|YP_001277075.1|   LRIREEIVSLWQTDEVRVVKPTVIDEVKNGLFYFESGLFDLIPRLYRELEYALRTAYPDH
ref|YP_284976.1|      LALANAILTLWQSRMLRPVRLKVLDEVKNGITYFKETFFTELPRLYIQATEQLQKRYPEK
                       :    : **::   :*   : .*:***:*.: ::.  :*  :*  ::  .    :. : :

ref|ZP_01696337.1|    RFKVPSYLHFGSWIGGDRDGNPNVTADITWKTLEMQRELVLEKYKKSLTTLRELLSHSSK
ref|ZP_02171753.1|    DFKVPNFIHFGSWIGGDRDGNPFVTPEVTWETLNLQRDLTLRKYEESITELMRRFSQSTT
RAAC00735             LLELPPLIRFGSWMGGDRDGNPNVTSDITWQTLVLHCDLALNKYEQKLRELGRDLSVSVD
ref|YP_001546997.1|   EWRVPAFLRFGSWVGGDRDGNPFVIPSVTVETLKLLMGRSLREHIHSVERLSHRLSQSSR
ref|YP_001277075.1|   EWRVPPLLRYGAWMGGDRDGNPNVTHAVTLQTVRLLRAAAVQRHITTIEELSHRLGQSTR
ref|YP_284976.1|      TWALPFFRVGSWIGGDRDGNPFVTADILREALRLQSSAALNHYLNEVHELGGELPLSDL
                       :*   ::  *:*:******** *   :  ::: :     :...:  :  *   :  * ref|ZP_01696337.1|    KISASHALLASVES-EENTMPAAKL----WPTKDEIYRRKLTIMIHKLECVGKNNGG---
ref|ZP_02171753.1|    RVDIDPEFIETMEQYEKKYMKKSET----WPVTTEIYRRMLGAIRKRIRQVGKTNTG---
RAAC00735             RAGADEDLLASLGG------ENDEP----YRALINRMLERLANTRRRLHGERVDGPD---
ref|YP_001546997.1|   QVPISEELAQSL--IHDAPLFPELAQVLERRNPHEPYRQKCSYIHAKLHATLAYVERYEP
ref|YP_001277075.1|   QAPVSEELRASL--ANDAALFPDVADMLTQRNPYELYRQKCTYIREKLLRTLNDANTASL
ref|YP_284976.1|      LVKVTPELLALAEH------STDHS----PQRADEPYRRALSGIYARLAATARALDQFEP
                                     :              :     .             ::

ref|ZP_01696337.1|    --------------YQSAKELLADLYMIRDSVNQHHPAGHPIKLLRKVIRQVELFGFHLA
ref|ZP_02171753.1|    --------------YDVAEELLADLRYVRENALKHQLPNQKLKQLNKMIRQVELFGFHLA
RAAC00735             --------------YASPEAMMEDVERMARSLAHHRGQRMVDAWLRPFLLQLRIFGFHMV
ref|YP_001546997.1|   DWARGGHRPAEGTWYANANQYLADLATMEYSLRTNGAASVADGFLRDIQCSAKVFGLHTA
ref|YP_001277075.1|   DWGRS--DPPPNGAYLRSDDLLADLRVMEQSLRANNAAVVADGALRDLIRQVEVFGLHTA
ref|YP_284976.1|      VRHEIG----HATPYDTPDALRDLKLLANSLKLNGSAKLAGGRLRRLLRGVQIFGFHLA
                                    *  ..   *:  :   .  :          *. .   .:**:* .
```

FIG. 21B

```
ref|ZP_01696337.1|      SLDIRNHSGEHESALAEVLYNVNIAKDYKNLSEDEKVAVLLKALNDPRPMISIYDTFTPE
ref|ZP_02171753.1|      TLDVRNHSGEHETAIAEILKVVGITEDYKSLDEEEKMTILENALKDPRPLMLLNEDYSEE
RAAC00735               TLDIRQHSGVHEQAVAELLQTAGLVDDYTSLGEEERVRVLSECLASPRPIRNPYHVYSDV
ref|YP_001546997.1|     TLDIRQHSSRHTNALSEIFEYAGICDDYASLSQAERTAVLERELANNRPLIPTHLYYSPE
ref|YP_001277075.1|     TLDIRQHSERHTAALAEVLASAGVCADYTALNETERIDLLSREIGNPRPLIPAHLDYSPD
ref|YP_284976.1|        PIDLRQNSDVHARSVAELLAGAGRCPDYEALSEAERIKLLVDEISTPRPLYSPYLNYSEE
                        .:*:*::*  *   :::*::  ..    **  *.:  *:   :*    :    **:      ::

ref|ZP_01696337.1|      TQEVINTFRMIKRAHQTFGERSIQVYLISMAHSVSDVLEVLVLAKEAGLYRVYPSGDIL-
ref|ZP_02171753.1|      TREIFKVFQMIKDAHEEFGQRSIEVYLVSMTQSASDLLEVLVLAKEAGIYRLHADGSV--
RAAC00735               TTEALAVLDCVRRGHETFGPRCVQDYLISMTQGASDLLEVLLLAKESGLFG-WPDGPMAP
ref|YP_001546997.1|     TVEIIETFRTIRAVLSDLNAEAIETYIISMTEGPSDILAVLLLAREAGIY-------QPG
ref|YP_001277075.1|     TVEVIQTFRTIAAILNRLSPEAIETYIVSMTRGASDLLAPLLLAKEAGLF-------RPF
ref|YP_284976.1|        TQGELAIFFAARELRQKYGSAALPNCIISKTDGVSDLLELALLLKESGLLL-----PGAK
                        *       :   :          . . .:    ::*  : . **:*      :* :*:*:

ref|ZP_01696337.1|      --SEIHIAPLLETIADLRNGAKMLETLFQMPIYRNHLKVRGNLQEVMLGYSDGSKDGGTM
ref|ZP_02171753.1|      -DSNLHVAPLLETVDDLMAGPAIMKRLFEMDIYRTHLGERGDHQEIMLGYSDGSKDGGTL
RAAC00735               PKSDLNVVPLFETIEDLESAAGIMRSLFENPVYRRHLEMRGWQQEIMLGYSDSNKDGGYL
ref|YP_001546997.1|     EHSWLNIVPLFETGADLIAAPEIMHTLLSSEAYRQHLVLRNDVQEIMLGYSDSNKDGGFA
ref|YP_001277075.1|     RFSRLNIAPLFETGADLTCCDTILEACLSLPVYRDHLALRGNLQEVMIGYSDSNKDVGYV
ref|YP_284976.1|        PQLKVNIIPLFETIEDLQKSAATMAGVFAIPAYRELIAGRGDEHEVMLGYSDSNKDGGFL
                        :::  :            :    :        :  *.  :*:*:**.. * ref|ZP_01696337.1|      TANWQLYKAQKEIHEMGAKYGIKLKFFHGRGGSLGRGGGPLYSSLLSQPPVTLGDGVKIT
ref|ZP_02171753.1|      TANWKLFEAQAKIHNMAKDYNVRLKFFHGRGGSLGRGGGPLNRSIVSQPAETLGDGVKIT
RAAC00735               TANWSLYMAQKHLIRLAEAYGVRIKFFHGRGGALGRGGGPVEQSILAQPTEALRGHVKIT
ref|YP_001546997.1|     DAHWALYLAQVALAETCFRHRVAMRLFHGRGGAVGRGGGPANRAILGQPPGTVGGRIKIT
ref|YP_001277075.1|     AANWALYQAQRKLRDFGRRYGIHMRLFHGRGGAIGRGGGPANHAILAQPPGSIGNQIKIT
ref|YP_284976.1|        TSGWELYKAEIELARIFGQHGVRLRLFHGRGGSVGRGGGPTYHAILAQPAGAVAGQIRLT
                        :  *  *:  *:   :      :  :  :::****:: **    :::.. :: . :::* ref|ZP_01696337.1|      EQGEVLSSRYLLRDIAYRSLEQATSTMMCAITEQKQNE-KNGKTPNEEAVRAMDKISEYA
ref|ZP_02171753.1|      EQGEVLSSRYLLGDIAFRNLEQAASALLEASANVYASPGDSCHIRRPQWEEAMEEISKAS
RAAC00735               EQGEVISQRYGHPGIAERSLESSAAAVLVGATREDSEE---WAERHPRWFRLLDRASEIS
ref|YP_001546997.1|     EQGEVISDRYAEPETAYRHQEQIINAVLRSSL---GVS---IAHISQEWHDAMSSLAKVS
ref|YP_001277075.1|     EQGEVIADRYGLPLLAHRHIEQVMNAVLRAGLLQRDDP---PAE----WMQALERLADLS
ref|YP_284976.1|        EQGEVISTKYGNADTGRRNLEVLLAATLE-ASLTDHEN---RVEPAEQFHAVMDELSARA
                        *****:: :*      . * *     : :                       :.   : :

ref|ZP_01696337.1|      LEKYQELVFRDPDFLSYFKQATPLNEIGELNIGSRPMSRKGSARFEDLRAIPWVFSWTQS
ref|ZP_02171753.1|      LSKYQSLVFKDPDFLTYFKETTPLNELKELNIGSRPMSRKGSERFEDLRAIPWVFAWTQC
RAAC00735               FRAYRKLVFEHPAFLEYFHRATPIDEIGKMNIGSRPSRRSQSARIEDLRAIPWVFSWTQS
ref|YP_001546997.1|     RKVYRGLVYDHPHFLEYFRNATPITEISRLNIGSRPASRKASDRIEDLRAIPWVFSWMQS
ref|YP_001277075.1|     QRHYRALVYERNDFVPYFHNVTPITEISRLNIGSRPASRRNTGRIEDLRAIPWVFSWMQS
ref|YP_284976.1|        FNAYRGLVYETPGFTTYFRQSTVVSEIASLNIGSRPASRKASERIEDLRAIPWVFSWAQC
                        *: **:     *   **:. * :  *:   :******    *  :*:**********:* *.

ref|ZP_01696337.1|      RQLLPAWYAAGTGLSKYV-EETGN----------------------FKL--LQEMY
ref|ZP_02171753.1|      RQMLPAWYASGTGLAAYGKASEEN----------------------LEL--LQDMY
RAAC00735               RHLLPAWYGFGSAIEAIMREDPRA----------------------LED--LRRMY
ref|YP_001546997.1|     RHTLPGWYGLGSALEHLIQA------DANG----------------LTT--LQGMY
ref|YP_001277075.1|     RHTLPGWYGMGFALETFVYKGDGIDLDMSGDSGNVTGDGTTDHVGSAIDRLAL--LQEMY
ref|YP_284976.1|        RLMLPGWYGFGAAVEGYLQANPAG----------------------LAT--LRRMV
                        *  **.**. *  .:                                 :   *: *
```

FIG. 21C

```
ref|ZP_01696337.1|      ASWPFFHATINNLQMALIKAELSTAEEYTRLVKDPEVAGRIFGLIKAEYELTKEMVLKIA
ref|ZP_02171753.1|      QNWPFFHSTINNLQMALMKADLFAAKEYVKLVKDQEMGQRIYGEIEKEFNLTKEMLLKIS
RAAC00735               EVWPFFRTLVDNLQMALAKADMLVAKEYAQLAG--EAGEAVFPLIEEEYARTERAVLDIT
ref|YP_001546997.1|     NDWPFFRTMLDNAQMILSKADMDIAAQYALLVPDQALANEIFGLIKAEYTRTVKWICEVA
ref|YP_001277075.1|     ARWSFFRVMIDNAQMILGKADLHIAARYAELAPDREAAASIFAAIRDEYGRTDRMIRQIA
ref|YP_284976.1|        HAWPFFKSLLSNMDMVLAKTDLAIASRYAELVADVELREHIFSRIKAEWALTRQHLLAIL
                         *.**:    :.* :* * *:::    *.*. *.           ::   *. *:    *   . :    :

ref|ZP_01696337.1|      DQKELLDYTPNIKESVRLRNPYVDPLNLFQVYLISQLRERENKD-EKARHLLMEVLLTIN
ref|ZP_02171753.1|      GSEQLLDFTPNIRDSVHLRNPYVDPLNFLQVDLIEKMR-ESSSE-ERTEELLTEVLLTIS
RAAC00735               GYRQLLDNRPVIRESISLRNPYVDPLSFFQVRLLADLRTDNLSP-EEREAELADALQTIN
ref|YP_001546997.1|     QINELLDTSPILQHSIKQRNPYVDPLSFVQIELLRRLRTDPDGL-EHSDLEDA-ILLSIN
ref|YP_001277075.1|     RIERLLDNSPVLQHSIQRRNPYIDPMSYLQIELLRRLRAAPDGP-QHAAIEDA-ILLSIS
ref|YP_284976.1|        EQDEFLADNPLLARSLQLRSPYMDPLNHLQVELLKRHRAG-----DTDERLARGIHLTIN
                         .:*     *  :   *: *.**:**:. .*: *:    *              :           :*.

ref|ZP_01696337.1|      GIAAGLRNTG
ref|ZP_02171753.1|      GVAAGLLNTG
RAAC00735               GIAAGLRNTG
ref|YP_001546997.1|     GIAAGLKNTG
ref|YP_001277075.1|     GLAAGLMNTG
ref|YP_284976.1|        GIASGLRNSG
                        *:*:** *:*
```

FIG. 22

```
ref|YP_001378696.1|    ------------------NKLVESADAAVADIRDGATVMVGGFGLCGNPENLIAALHRKG
RAAC00812              MHHGASRLGRMGVRFMRSNKVYESAGAAIADIPNGATLLVGGFGLCGIPMALIQALRDRG
ref|YP_386234.1|       ------------------KVQSSIEKALEGIQDGATLMVGGFGLVGIPEKLILGLREKG
ref|ZP_01723286.1|     --------------MKDGKVWGSFEEAVADIKDGDMLAVGGFGLCGIPEKAIAALVQKG
ref|NP_391778.1|       ------------------KVLSSSKEAAKLIHDGDTLIAGGFGLCGIPEQLILSIRDQG
ref|ZP_00539373.1|     ---------------MQQGKIYDSFTEATADIFDGATLVVGGFGLCGIPEKSIAALQEQG
                                         *:   *     *  *:*  : .***** *  *  .:   :* ref|YP_001378696.1|    VKDLTVISNNCGTTEQGLGILLKARQIRKMVSSYVGENKEFERQYLSGELEVELVPQGTL
RAAC00812              VSDLVCVSNNCGVDDWGLGILLQTRQIRKMVSSYVGENKTFERQFLNGELEVELVPQGTL
ref|YP_386234.1|       VKNLTVISNNCGVDDFGLGILLQNRQIRKMVSSYVGENKEFERQFLSGELEVELTPQGTL
ref|ZP_01723286.1|     TKDLTVVSNNCGVDDWGLGLLLANKQIKKMVASYVGENKIFEQQFLSGELEVELTPQGTL
ref|NP_391778.1|       VKDLTVVSNNCGVDDWGLGLLLANKQIKKMIASYVGENKIFERQFLSGELEVELVPQGTL
ref|ZP_00539373.1|     VKELTVVSNNCGVDDFGLGILLQSRQIKKMVSSYVGENKTFEQQYLSGEIEVDLVPQGTL
                        ..:*.  :***.  : *:  :::.**  :*:*.::* ***** ref|YP_001378696.1|    AERIRAGGAGIGGFYTATGVGTQVAEGKETRVIDGREYLLERPLVADFALVYAWKADTWG
RAAC00812              AERIRAGGAGIPAFYTATGVGTSVAEGKEVRTFDGREYVLERAITGDFALIKGWKADKLG
ref|YP_386234.1|       AERIRAGGAGIPAFYTPAGVGTPLAEGREVRSFNGREYLLETGLVADFALVKAWKGDWMG
ref|ZP_01723286.1|     AERLRAGGAGIPGFYTATGVGTPIAEGKEVKVFDGKDYILEKGITADFALVKAWKADKLG
ref|NP_391778.1|       AERIRAGGAGIPGFYTATGVGTSIAEGKEHKTFGGRTYVLERGITGDVAIVKAWKADTMG
ref|ZP_00539373.1|     AERIRAGGAGIPGFYTPTGVGTPIAEGKEQKQFDGKTYLLEEGIVGDFALVKAWKADKLG
                       *:***  .*.**  :*:*  :   :.:  *:** :...*.*:: .**.*   * ref|YP_001378696.1|    NLLYRKTTRQFGPMMATAARITIAEVEHVVQPGEIDPDVVHTPSIYVKRLVRGERYEKWI
RAAC00812              NVIYHETERNFNPVMATAAKVTIEVEELVEPGELDPNFIHTPSIYVHRIVVNPNPIKRI
ref|YP_386234.1|       NLIYNKTSRNFNPMMATAAKVTIAEVEDLLDPGELDPAFIHTPGVYVQRIVLCGNYEKRI
ref|ZP_01723286.1|     NLVYRKTSRNFNPLAAMAGKITIAEVEEIVEIGELDPDHIHTPGVFVQRVLLGENYEKRI
ref|NP_391778.1|       NLIFRKTARNFNPIAAMAGKITIAEAEEIVEAGELDPDHIHTPGIYQHVVLGASQEKRI
ref|ZP_00539373.1|     NLVFRKTSRNFNPLVATAGKVTIAEVEELVEVGELDPNEIHTPAVYVQRIIVGTDYEKRI
                       *::: .:* *:*.*: * *.::**.*.*.*.:::  :   :***..::*::::         * * ref|YP_001378696.1|    ERRTVRPR---
RAAC00812              ERRTVRPRPQA
ref|YP_386234.1|       ERRTVR-----
ref|ZP_01723286.1|     ERLTVK-----
ref|NP_391778.1|       EKRTVQ-----
ref|ZP_00539373.1|     ERRTVR-----
                       *: **:
```

FIG. 23A

```
ref|YP_147293.1|        --------------------------------MNITIRLQFEKDIVSFSDIAAAIGKAGGDI
sp|P16468|MAOX_BACST    --------------------------------MNITIRLQFEKDIVSFSDIAAAIGKAGGDI
ref|YP_001125416.1|     ------------------------------------------------------------
ref|YP_075148.1|        ------------------------RLASMRIIVRLEIENTGSIFSYIATAIGASGGDI
ref|YP_643888.1|        ---------------------------------------------ALGRILTTIGDAGGMV
RAAC00196               MFQSAWLMRMAEPWPETQGEWNVTLTRAGNVRVLFRVRLEAG-AALGEVHGAIVRAGGEI ref|YP_147293.1|        VGIDVISSSKVHTVRDITVSALDTKQCDLII-EALKKIQGVKIINVSDRTFLMHIGGKIE
sp|P16468|MAOX_BACST    VGIDVISSSKVHTVRDITVSALDTKQCDLII-EALKKIRGVKIVNVSDRTFLMHIGGKIE
ref|YP_001125416.1|     -------------MRDITVSALDTKQCDLII-EALKKIRGVKIVNVSDRTFLMHIGGKIE
ref|YP_075148.1|        VAVDLIQSRRDVVVRDITIAVENRAHGDRIV-QALAALPGVKVVNVSDRIFLAHLGGKIE
ref|YP_643888.1|        GAIDIVRMGQERSIRDITVNARDSEHGQRIV-RAVGALPEVRVVNVSDRTFLLHLGGKIE
RAAC00196               VAMETRALHADHSVRDITVAV-DTEPDVRAVEQALDEVQGVKRLETLDRTFLVHVGGKIA
                                     :****:    . :      :  .*:   :  *: ::.   *:**** ref|YP_147293.1|        TNSKIPVKTRDDLSRVYTPGVARVCTAIAEDPRKAYSLTIKRNTVAVVSDGTAVLGLGDI
sp|P16468|MAOX_BACST    TNSKIPVKTRDDLSRVYTPGVARVCTAIAEDPRKAYSLTIKRNTVAVVSDGTAVLGLGDI
ref|YP_001125416.1|     TNSKIPVKTRDDLSRVYTPGVARVCTAIAEDPRKAYSLTIKRNTVAVVSDGTAVLGLGDI
ref|YP_075148.1|        VKPRVQVKTRDDLSVVYTPGVADVCRAIAQEDPAKAFTLTIKRNTVAVVTDGTAVLGLGNI
ref|YP_643888.1|        VHSKIPVRTRDDLSMAYTPGVARVCRAIAQEPERAFNLTIKRNSVAVVTDGTAVLGLGDI
RAAC00196               THLKVPVVDRDDLAVVYTPGVARVCEAIRDRRDRAFEFTIRKNTVAVVSDGSAVLGLGNI
                        .: :: * **: .**  **  :   :*: :**::*:**::****** :* ref|YP_147293.1|        GPYAAMPVMEGKAMLFKEFAGVDAFPICLNTKDTEEIIQIVKAIAPAFGGINLEDISAPR
sp|P16468|MAOX_BACST    GPYAAMPVMEGKAMLFKEFAGVDAFPICLDTKDTEEIIQIVKAIAPAFGGINLEDISAPR
ref|YP_001125416.1|     GPYAAMPVMEGKAMLFKQFAGVDAFPVCLDTKDTEEIIQIVKAIAPAFGGINLEDISAPR
ref|YP_075148.1|        GPAAALPVMEGKAMLFKEFAGVDAFPICLDTTDPDEIVRIVKAIAPAFGGINLEDISSPR
ref|YP_643888.1|        GPYAAMPVMEGKAMLFKEFAGVDAFPVCLDTKDPEEIVRTVKYVAPAFGGINLEDISAPR
RAAC00196               GPEAAMPVMEGKAMLFKRFADVDAFPICLATQDVDEIVETVERMAPSFGGINLEDISSPR
                        **  **:**********:**.******:**  ::.*:.  *: :**:***********:**

ref|YP_147293.1|        CFEIEKRLKEELDIPVFHDDQHGTAVVLLAGLLNALKIVDKKLEDIKVVLTGIGAAGIAC
sp|P16468|MAOX_BACST    CFEIEKRLKEELDIPVFHDDQHGTAVVLLAGLLNALKIVDKKLEDIKVVLTGIGAAGIAC
ref|YP_001125416.1|     CFEIEARLKEELDIPVFHDDQHGTAVVLLAGLLNALKIVDKKLEDIKVVLTGIGAAGIAC
ref|YP_075148.1|        CFEIEERLKEELDIPVFHDDQHGTAVVVLAGLMNAARVGKELADLRVVCGIGAAGVAI
ref|YP_643888.1|        CFEIEERLKQELDIPVFHDDQHGTAVVVLAALINALRIVGKRMEELKVVCGVGAAGVAC
RAAC00196               CFEIEERLRKRLDIPVFHDDQHGTAVVMLAGLINALKIVNKRMQDVSVVVAGVGAAGVAC
                        *** ::.*************:.:*** ::*.*.: :: **: *:****:* ref|YP_147293.1|        TKILLAAGVRNIIGVDRHGAIHRDETYENPYWQEYAQITNPDNLKGSLSDVIAGADVFIG
sp|P16468|MAOX_BACST    TKILLAAGVRNIIGVDRHGAIHRDETYENPYWQEYAQITNPDNLKGSLSDVIAGADVFIG
ref|YP_001125416.1|     TKILLAAGVRNIIGVDRYGAIHRDETYENPYWQEYAQITNPYNLKGSLSDVIVGADVFIG
ref|YP_075148.1|        SKMLMAAGITNIVGVDRVGIIERGKTYENPMWQWYAEHTNPENRHGTLDDAIEGADAFIG
ref|YP_643888.1|        AKILLAAGVKNIVGCDRYGVVYRGRGDADTSRGWFAENTNPENIRGTLADAIRGADVFIG
RAAC00196               TKILLAAGVGHIVGVDRVGIIERGRHYDNPVKQWYAENTNSENRRGTLEEAVRGADVFIG
                        :*:*:***: :*:* ** *  *  : *..   :.      :*: **. * :*:* :.: *.* ref|YP_147293.1|        VSAPGILKVEDVKKMARDPIVFAMANPIPEIDPELAEPYVRVMATGRSDYPNQINNVLCF
sp|P16468|MAOX_BACST    VSAPGILKVEDVKKMARDPIVFAMANPIPEIDPELAEPYVRVMATGRSDYPNQINNVLCF
ref|YP_001125416.1|     VSAPGILKVEDVKKMARDPIVFAMANPVPEIDPELAEPYVRVMATGRSDYPNQINNVLCF
ref|YP_075148.1|        VSAPNVLKVEHVKKMAKDPIVFAMANPVPEIDPDEAAPYVAVMATGRSDYPNQVNNLLCF
ref|YP_643888.1|        VSAPDVLTVEHIESMADEPIVFAMANPDPEIRPEIAYGHARIIATGRSDYPNQINNVLCF
RAAC00196               VSGPGILTVGHVKQMARDPIVFAMANPIPEILPEVAAGHVRVMATGRSDYPNQINNVLCF
                        **.*.*:.*.*  .::.**  :********   ***  *:    :. .::***********:**:***
```

FIG. 23B

```
ref|YP_147293.1|         PGIFRGALDCRAREINEEMKLAAAKAIASVVTEDELNETYIIPSVFN-------------
sp|P16468|MAOX_BACST     PGIFRGALDCRAREINEEMKLAAAKAIASVVTEDELNETYIIPSVFN-------------
ref|YP_001125416.1|      PGIFRGALDCRAKEINEEMKLAAAKAIASVVTEDELNETYIIPSVFN-------------
ref|YP_075148.1|         PGIFRGALNCRARQINEAMKLAAARAIASVVSDEELHAEYIIPSVFN-------------
ref|YP_643888.1|         PGVFRGALDIRAREINEEMKLAAARAIAGVIPEESLSEDYIIPSVFD-------------
RAAC00196                PGMFRGALDVRARDITEEMKQAAALAIAECVPEEQLSEQYIIPSPFDPNVVPAVSRAVQA
                         **:*****: **::*.* ** *** ***  :.::.*    ***** *:

ref|YP_147293.1|         -------------------------
sp|P16468|MAOX_BACST     -------------------------
ref|YP_001125416.1|      -------------------------
ref|YP_075148.1|         -------------------------
ref|YP_643888.1|         -------------------------
RAAC00196                AAVRSGVARAAAPLELEEEPLYTEM
```

FIG. 24

```
ref|NP_242895.1|      -EEVVIASGVRTPIGRFGGHLKDLKAPTLGALVISEALHRAGVLNEQVDEVIMGNVLQAG
ref|ZP_01372991.1|    MQDVVIVSAVRTPIASFGGALQGYGAVNLGALVIREAVQRAGIQGKQVDEVIMGNVLQAG
ref|ZP_01666093.1|    MREVVIASAVRTAIGSFNGTLAPFSAPELGSFVIKAALERANVPASAVDEVIMGNVLQAG
ref|YP_360188.1|      MEEVVIVSAVRTPIGSFLGSLAQTPAVDLGALVIKESLNRINLAPRFVDEVIMGNVLQAG
ref|YP_360122.1|      MQEVVILSAVRTAIGKFGGSLKDIPAAELGAIVIKEALVRAQIPPAEVDEVIFGNVLQAG
RAAC00814             MQDVVIAGAVRTPIGTFQGSLSPLSAPDLGAAVIRESLRRAGVEAGAVDEVVMGNVLQAG
                       .:*..*.*. * *    *  :    :: *  :   **::***** ref|NP_242895.1|      LGQNPARQAALQAGLPETVPAMTINKVCGSGLKAVHLASQAIACGDAEIVVAGGMENMSQ
ref|ZP_01372991.1|    LGQNPARQAALKAGLPVETTAQTINVVCGSGLKAVIAAAQAIRAGDAEIVAAGGMESMSD
ref|ZP_01666093.1|    LGQNPARQAALKAGLPVEVPTMTINKVCGSGLKAVNLAAQAIMTGDADIVVAGGMESMTN
ref|YP_360188.1|      LGQNPARQAAIKAGIPQEVPAFTVNKVCGSGLKSVGLAYQAIATGDADIVVAGGMENMSL
ref|YP_360122.1|      QGQNPARQAAIKAGIPVDIPAMTVNMVCGSGLRSVSLAATLIAAGEADLIVAGGMENMSA
RAAC00814             VGQNPARQAAMRAGLPEDIPATTVNMVCGSGLKSVMLAAQAIRAGDADVLVAGGMESMSN
                       *********::**:*   .: *:* *****::*   *    *:*:::.*****.*:

ref|NP_242895.1|      APYLAVGARNGYRMGHHQLIDSMIHDGLWCAFNDYHMGITAENLCEQYGLSRTELDEFSA
ref|ZP_01372991.1|    AAFLLDQARWGQRMGHGTLVDSMIKDGLWCAFNEYHMGITAENVAEKYGISRREQDEFAA
ref|ZP_01666093.1|    APYLLDKSRWGYRMGHGKLIDSMITDGLWCAFNDYHMGITAENIVEKYGVTREEQDQLAF
ref|YP_360188.1|      APYVLPKARTGYRMGHDTLIDSMIKDGLWCAFTDVHMGITAENIAEKYNITREEQDKFAL
ref|YP_360122.1|      APYAIPGARWGTRMGDGKIVDLMIKDGLWDAFYDYHMGITAENLAERYNISREEQDRFAL
RAAC00814             APYLLPGAREGYRMGHREVVDSMIRDGLWCAFCDIHMGVTAENVANRHGISREDQDRFAL
                      *.:    :*  * ***. ::* ** **** **  : ***:****:  :::.::*   *.::

ref|NP_242895.1|      WSQEKAVQAIESGRFKDEIVPVDIPQRKGEPIQFDTDEYVKRGTTTETLGALRPAFKKDG
ref|ZP_01372991.1|    WSQAKAVAAMEKGRFKEEIVPVAIPQRKGEPVIFDRDEYPRAGTTVETLAKLKPAFKKDG
ref|ZP_01666093.1|    ESQDKAIKAIASGAFKKEIVPVVIKDKKGD-KIFDTDEYPRAGTTVEKLCALKPAFKKDG
ref|YP_360188.1|      QSQERAIKAIDEGKFKEEIVPVPIIPQKKGEPLVFSTDEFPKRGTSLEKLAALKPAFKKDG
ref|YP_360122.1|      ESQRRAEKAIKEGRFRDEIVPVKLPQRKGEPLEFVQDENPRFDTTLEALAKLKPAFKEGG
RAAC00814             QSQMRAKEAMEAGRFKDEIVPVSVPRRKGEPTLVDCDEHPRPDTTYEALAKLRPAFQADG
                       **  :*  *:    * *:.***   :  ::    .  ** :  * *  *:***: .* ref|NP_242895.1|      KVTAGNASGINDGAAAVVVMSKEKAVELGIKPLVTVRANATAGVEPRIMGIGPVPATKKA
ref|ZP_01372991.1|    TVTAGNASGINDAAAACVLMSKEKAAALGIPYLAAIKGYGMAGVDPAIMGVGPVNAVKKA
ref|ZP_01666093.1|    TVTAGNASGINDGAAALVVMSADKAKELGIKPMARIRSYASAGVDPSIMGMGPVPATRKA
ref|YP_360188.1|      TVTAGNASGINDGAAAVVVMSAKKAQELNIKPLAVIRGYAAAGVDPAYMGLGPIPATRKA
ref|YP_360122.1|      TVTAGNASSINDGAAAALVIASSKKAEAGIKPMAVIRSWGATGVDPSIMGIGPVGATRKA
RAAC00814             TVIAGNSSGINDGAAAMLVLARDRAEALGVKPMARIVSYASVGLDPSVMGLGPIEATRRA
                      .* ***:*.*.*  ::    ..:*   *.:   :. :   .*::*  : *.::* ref|NP_242895.1|      LTKAGLTMDDIDLIEANEAFAAQSLAVAKELSFAEDRLNVNGGAIALGHPIGASGTRIFV
ref|ZP_01372991.1|    LQKAGIALDELDLIEANEAFAAQALAVTKELGFPGEKVNVNGGAIALGHPIGASGTRILV
ref|ZP_01666093.1|    LAKAGLVMDDIDLIEANEAFAAQFLAVGKELGFVKEKVNVHGGAIALGHPIGASGARILV
ref|YP_360188.1|      LKKANLTVSDLGLIEANEAFAAQALAVIKELELNPEITNVNGGAIALGHPIGASGARILV
ref|YP_360122.1|      LKRAGLTIADIDLVEANEAFAAQALAVAKELELDLSKTNVNGGAIALGHPIGASGARILV
RAAC00814             LGRAGLSVEDLDLIEANEAFAAQALAVARELSFPDDKLNVNGGAIALGHPIGASGARILV
                      * :*.:  : ::.*:******* *  :  :    . :****************:*:* ref|NP_242895.1|      TLLHELLRRGETYGLATLCIGGGQGVATIIER---
ref|ZP_01372991.1|    TLVHEMKKRRDKLGLATLCIGGGQGIALVVE----
ref|ZP_01666093.1|    TLLHAMELRNVKTGLATLCIGGGQGVATIVERM--
ref|YP_360188.1|      TLLHEMQKRNTKYGLATLCIGGGQGFALVVEKV--
ref|YP_360122.1|      TLLHEMKKSNSRYGLATLCIGGGMGVAAIVEK---
RAAC00814             TLLYELERRGGRFGLATLCIGGGQGVAMVVERMSQ
                      **::  :           ********* *.*  ::*
```

FIG. 25A

```
ref|NP_294183.1|    ----------------------------------------------------------------
ref|YP_605214.1|    ----------------------------------------------------------------
ref|YP_644483.1|    ----------------------------------------------------------------
RAAC00815           MRRDPRGRRSVEHDRERPAHPATGGLRGPVLSLELRRVPREISSVHRRSGGILGRDRRRV
ref|YP_359514.1|    ----------------------------------------------------------------
ref|YP_592595.1|    ---------------------------------------------------------------- ref|NP_294183.1|    -----------------------------------------KNRVALYYEREDGLKETWS
ref|YP_605214.1|    -----------------------------------------RTALLYEREDGLRETWT
ref|YP_644483.1|    -----------------------------------------RNKAALLWESEDGRREVWT
RAAC00815           GMAAARKDGHRGRASRFSVLSRKLHQRVRKLRGSTSQAPDVRNKVALFFEGEDGERRSVT
ref|YP_359514.1|    -----------------------------------------RNKAALIFEGEPGDSKILT
ref|YP_592595.1|    -----------------------------------------RHKAAFIWEGEPGDVRTLT
                                                             :.*: :*  *  *   . :

ref|NP_294183.1|    YGDLTDATARFAAALQDLGVDKGDRVAIYLSNVPEAFIAIHACYRIGAIYSVIFAGFSAS
ref|YP_605214.1|    YGELTDATARFAAALQDLGVAKGDRVAIYLGNVPEAFIAIHACYRIGAIYSVIFAGFSAS
ref|YP_644483.1|    YQQLADEVNRFANVLRELGVGRGDVVAIYMGNIPEVFVSVHACYRIGALYSIIFAGFSTD
RAAC00815           YLQLQDAVSRFANALKDLGLRQGDVVCVYMQNLIETYVALLACLRIGVLYNTVFAGFSAE
ref|YP_359514.1|    YQELYREVNKFANVLKKLGVQKGDRVTIYMPMIPEAVIAMLACTRIGAPHSVVFGGFSSQ
ref|YP_592595.1|    YQQLWLEVQKFANVLLDLGIKKGDRVAIYMGMVPELPVAMLACARIGATHSVIFGGFSAN
                     * :*     .:**   .**: :**  *  :*:   * ::: **.***. ::. :*.***:.

ref|NP_294183.1|    AVRDRLTDAQPKVVVCTDGTLRRGRNIPLKATLDEALEGLEKPT-VIVARRLD-----PF
ref|YP_605214.1|    AVRDRLTDARPKVVICTDATLRRGKVIPLKATLDEALEGLE-IGHVIVARRV----DRES
ref|YP_644483.1|    AVRQRLEDARPKVVVVADATSRRGREVPLKRTLDQALAGIDSVETVVVVPRA----GAET
RAAC00815           ALRERIVRCGAKAVICANGSLRRGRVLRLKETVDRALEGVETVEHVIVYRRLP---DLDT
ref|YP_359514.1|    ALKDRIDDAKALLITADGGYRRGSIVELKKNADAALEGETTIEKVVVVKRTGQ----EV
ref|YP_592595.1|    ALVDRITDQQAVAVITQDGSWRRGNEVKLKVAVDEALEKCPTVKHVVVYKRTASA---IN
                    *: :*:      .    ::   :.    *   :      * **          *:*   * ref|NP_294183.1|    LPLGENELDFAELLEKTTRRAAPVSLDANDPGFIIYTSGTTSKPKGLVHSGIGFLTGTYA
ref|YP_605214.1|    ALRGGEH-DFHALLNSTARRADPVPLEANEPGFIIYTSGTTSKPKGLVHAGLGFLAGAYA
ref|YP_644483.1|    ELREGRDRLYGDLVSRAGAWCPPEPMEANEPGFIIYTSGTESRPKGLVHAGLGFLVGTYA
RAAC00815           PMTPGRDLDFESLVERASRDCPPAVLEANEPAFLIFTSGTTGRPKGIVHAGGGFLLGTYA
ref|YP_359514.1|    PMTEGRDYWYHELMADAALYCEPEQCDAEDMLFILYSSGTTGKPKGIQHTTGGYLVGVHT
ref|YP_592595.1|    -MKEGRDHWWHDLMAKAKDHCPAEPLDAEHPLYILYTSGTTGKPKGIVHTTGGYAVGTYY
                      ..   :  *:   :   .   . :*:.  ::::::***  .:***: *:   *: *.:

ref|NP_294183.1|    NVKWALNLQPDDVYWCTADVGWLTFPIFALVGGLAHGATHVIYEGSIDTPTPERPYQIIE
ref|YP_605214.1|    NVKWALNLCPQDVYWCTADVGWLTFPIFALVGGLAHGATHVIYEGSIDTPTPARPYEIIE
ref|YP_644483.1|    DVKWSMNPQDDDVYWCTADVGWLTFPIWSLVGGLAHGTTMVVYEGALNHPDPGRFYEILE
RAAC00815           YTKYQLDLRPEDVYWNTADIGWLTSHIFVLVGGLALGTTTILYEGALDWPKSGRLYEMIE
ref|YP_359514.1|    TFKYIFDYREEDIYWCTADIGWITGHSYIVYGPLSNGATVVLYEGAPDWPQKDRFWEIIE
ref|YP_592595.1|    TTKMVFDLKEDDTFWCTADIGWVTGHSYIVYGPLQTGATTVMYEGAPNFPDLDRFWALVA
                      *  ::    :*  :* ***:**:*  :  :   *    *:*  ::***: :  *      *   : ::

ref|NP_294183.1|    RYRADKVFTAPTALRMLRRSGDEALARYDLSPLQLVALVGEPLDPETWHWTHDVLGGGRL
ref|YP_605214.1|    RYGVNKVFTAPTALRMLRRAGDSALAGHDLNTLELIALVGEPLDPETWHWTRERLGAGRI
ref|YP_644483.1|    RYRVNKVFTAPTALRMLRGAGERWLEGRDLSALKLVSLVGEPIDPETWHWVREVVGRGEA
RAAC00815           RYRVNKLFSAPTAYRMMMKHGEDIARQYDLSSLELLVSVGEPFNPEAWHWVRRVVGGDVA
ref|YP_359514.1|    KYRVNILYTAPTAIRTFMRWGEKWPKGRDLSSLRLLGTVGEPINPEAWIWYHEHIGGGRC
ref|YP_592595.1|    KHKVTVFYTAPTAIRTFMKWGAEYPNRHDMSTLRLLGSVGEPINPEAWMWYRDVIGKDRC
                    ::  .   . ::****  * :    *      *:..*.*:  ****::**:* *   :  :*  .
```

FIG. 25B

| | |
|---|---|
| ref\|NP_294183.1\| | FVNNTYGQTETGTAWASSMVGLTEGRPGSCGHPLPGYRAAVVHEDGTPCGPNELGSLTLT |
| ref\|YP_605214.1\| | FVNNTYGQTETGTAWASSMVGLTPTRPGSCGHPLPGYRARVVREDGQAAAPGELGALTLT |
| ref\|YP_644483.1\| | FVNNTYGQTETATGWTSAIVGLTGAKPGSCGIPLPGYVSEVVDEGGRPVPPGTPGYLTIT |
| RAAC00815 | VINNTWGQTETGGTPLALLPGAVPMKPGSCGVPFFGHDLAVVDEQGREVPDGVPGYLVIR |
| ref\|YP_359514.1\| | PIVDTWWQTETGMIMITPLPGVIPTKPGSATKPFPGVEADVVNDKGEPVPPGQGGYLVLK |
| ref\|YP_592595.1\| | PIVDTWWQTETGAIMISPLPGAIATKPGSATKPLPGIIAEVVTRAGEKVPLGSGGFLVIK |
| | : :*: ****.      : : *    :***. *; *    **   *   . * *.: |

| | |
|---|---|
| ref\|NP_294183.1\| | EPFPCLARTVWGDHDRYVETYLSEFPGKYAAADAALLDSDGQLWVTGRLDDVMNVAGHRL |
| ref\|YP_605214.1\| | EPFPCLARTVWGDHERYVQTYLADFPGSYAASDAALLDGDGQLWVTGRLDDVMNVAGHRI |
| ref\|YP_644483.1\| | EPFPCLARTVWGDHQRYLSTYFERFPGRYFSADACVVDRDGHYWVTGRVDDVINVAGHRL |
| RAAC00815 | RPFPSLARDVYGDRNLYLNAYFSRMPGLYFTGDSAVRDADGHFWVLGRVDDVINVSGHRI |
| ref\|YP_359514.1\| | KPWPAMLRTLYGDPERYKNTYWSKFPGWYFTGDGAKKDEDGYFWILGRVDDVINVSGHRI |
| ref\|YP_592595.1\| | KPWPSMMRTIYGDPERYKHQYWSDIPGVYFTGDGAREDKDGYFWIMGRVDDVLNVSGHRL |
| | .*:*.: * ::**  :  *     :** * :.*.. * **  *; :*::*: |

| | |
|---|---|
| ref\|NP_294183.1\| | GTMEMEAALLTHPAVSEAAVVAMPDDIKGAVPVAFVVPRAGIRLDTDLTWLENELADAVV |
| ref\|YP_605214.1\| | GTMELEAALITHPAVSEAAVVAQPDEVKGSVPVAFVVPRGDAQVG---PGLEEELAEAIV |
| ref\|YP_644483.1\| | GTMEMESALLNHPDVAEAAVIGVPDATKGTVPVAFALLRAGAEPR---PGLREELEQRIV |
| RAAC00815 | STMEMESSLIQHPAVVEAAVVGEPDDVKGQVPVAFVTLERGWEPS---TDLEEELKARVV |
| ref\|YP_359514.1\| | GTMEVESALVEHPLVAEAAVIGKSHEVKGQAIAAFVTLKEGVEGT---PELVQELKQFVA |
| ref\|YP_592595.1\| | STMEIESALVAHPKVAEAAVVGRPDEMKGQAVSAFVTLESGSKPS---PELKEELRAWVA |
| | .***:*::*: ** * ****:. .. **  **. ...  . * :**    :. |

| | |
|---|---|
| ref\|NP_294183.1\| | SGVGAIARPGRVVVTPTVPRTRSGKIMRRLLRDLLLTGEVKGDLTSLENPDALE----TV |
| ref\|YP_605214.1\| | RGVGPIARPARVIVTPTVPRTRSGKIMRRLLRDLLVSGEVRGDLTSLENPDAIE----VV |
| ref\|YP_644483.1\| | ERVGSIARPAAVHIVSALPKTRSGKIMRRLLRELVTEGRVRGDTTALEDPESVS----VL |
| RAAC00815 | ADIGSFARPARVYFVEAMPKTRSGKILRRMLREILQTGEVKGDVTGLEDWEVVERLLHDL |
| ref\|YP_359514.1\| | QKIGALARPDDIFFTAELPKTRSGKIMRRLLRDIAE-GRALGDTTTLTDPAVIN----KI |
| ref\|YP_592595.1\| | KEIGSMAKPDDIRFTDLPKTRSGKIMRRLLRELATGGDVKGDTTTLEDFTVIA----KL |
| | :*.:*:*   :  ..  :*:****::**::   * . ** * * :   :      : |

| | |
|---|---|
| ref\|NP_294183.1\| | RERLGGAAAG |
| ref\|YP_605214.1\| | RERLAGG--- |
| ref\|YP_644483.1\| | EKEL------ |
| RAAC00815 | RERAPGGE-- |
| ref\|YP_359514.1\| | KEQYKD---- |
| ref\|YP_592595.1\| | KED------- |
| | .: |

FIG. 26

```
ref|YP_147450.1|      MNFSLTKEQQMIKEMVRDFAEKEIAPYAAKWDEEAHFPLDVFRKMGELGLLGLPFPEEYG
ref|YP_001125561.1|   MDFSLTKEQQMIKEMVRDFAEKEIAPYAAKWDEEAYFPREVFRKMGELGLLGLPFPESYG
ref|ZP_01696479.1|    MDFELSKEQIMLQEMVRDFAEKEIEPYAREVDETGKMRMETFQKLGNLGLLGIPFPEKYG
ref|NP_241996.1|      MNFELTKEQQMVRDMVRDFAENEIAPNAIHYDKTAQFPEDVFKKMGELGLLGIPFPEEYG
ref|YP_079308.1|      MNFELTREQQMIRELARDFAKQEIAPHAEHVDRTGEFPIETFKKMGELGLLGIPFPESYG
RAAC00816             MDFDLTSEQKMIRDTVREFAEAEIAPHAAEWDRTEHFPIEVFRKMGELGFLGLPIPEEYG
                      *:*.*: ** *::: .*:**: **  *  . *.     :  :.*:*:*:**:**:**.**

ref|YP_147450.1|      GAGGDTISYAIAVEEIGRACGGTGLSYAAAVSLGASPIYYFGTEEQKQWLVPMAKGETL
ref|YP_001125561.1|   GAGGDTISYAIAVEEIGRACGGTGLSYAAAVSLGASPIYYFGSEEQKQTWLVPMAKGETL
ref|ZP_01696479.1|    GAGGDTISYCIAVEEIGKACGGTGLSYAANTSLGASPIYYFGTEEQKQKWLVPMAKGEAL
ref|NP_241996.1|      GSGGDTISYALAVEEVGRACGGTGLSYAAAVSLGASPIYYFGTERQKQEHLVPLATGESL
ref|YP_079308.1|      GSGGDTISYALSVEEIGKACGSTGLSYAAAVSLGAAPIYYFGTEEQKQEYLVPLATGRAL
RAAC00816             GAGADMISYCLAVEEIGRACGGTGLSYEAHVSLACTPILLYGTEEQKQKYLVPMARGEAL
                      *:*.* *.::*:* *** *...:   :*:*.* * :* *.:* ref|YP_147450.1|      GAFGLTEPNAGSDAGGTRTTAVLDGDEYVINGEKCWITNAQYARQVIVTAVTGKDARGKN
ref|YP_001125561.1|   GAFGLTEPNAGSDAGGTRTTAVLDGDEYVINGEKCWITNAQYARQVIVTAVTGKDARGKN
ref|ZP_01696479.1|    GAFGLTEPNAGSDAGGTRTKAVLDGDEWVINGEKCWITNAEYARQVIVTAVTGKRENGRN
ref|NP_241996.1|      GSFGLTEPNAGSDAGGTRTKAVLEGDEYVINGEKCWITNAGYARTVIVTAVTGKDERGKP
ref|YP_079308.1|      GAFGLTEPNAGSDAGGTRTKARSEGDSYVISGEKCWITNAGFARTVIVTAVTGIDDNGKN
RAAC00816             GAFGLTEPGAGSDAGGTRTTAVLEGDEWVITGNKIFNTNGGYAKYVVLTAVTDPASRG--
                      *:**** .********.*  :.:.*:*   :  **. :*: *:::****.    .* ref|YP_147450.1|      IITALIVPTDSPGFTIRSNYDKMGVRASNTCELVFENVRVPKENVLGDPQKGFKQFLYTL
ref|YP_001125561.1|   IITALIVPTDSPGFTIRSNYDKMGVRASNTCELVFENVRVPKENVLGDPQKGFKQFLYTL
ref|ZP_01696479.1|    IISAIIVPADAPGVAITSPYEKMGVRGSNTCQIVLENVRVPRENLLGDENKGFSQFLYTL
ref|NP_241996.1|      VISALIVPTGIEGFTISCNYDKMGVRASNTCELVLEDVRVPKENLLGDPTKGFKQFLYTL
ref|YP_079308.1|      IISAIIVPTDSEGFTIKSEYDKMGVRGSNTSQLILDNVRVPKQNLLGSPEKGFKQFLNTL
RAAC00816             -ISAFIVPTDAEGFSVSKPYEKLGMRASNTVELILDHVRVPKENLLGPLNAGFKQFLSTL
                       *:*:***:.    *.::    *:*:*:*.* :::::.**:*:  * ref|YP_147450.1|      DGGRISIAALAVGIAQAAFEKALQYAKERVQFGQPISKFQAIQFKLADMAMEIELARNMV
ref|YP_001125561.1|   DGGRISIAALAVGIAQAAFEKALQYAKERVQFGQSISKFQAIQFKLADMAMEIELARNMV
ref|ZP_01696479.1|    DGGRISIAALSVGIAQAAFEKALRYAKERMQFGQAISKFQAIQFKLADMAMEIDLARNAV
ref|NP_241996.1|      DGGRISIGALAVGIAQADRALAYANERKQFGQKISSFQAIQFKLADMAMEIELARNMV
ref|YP_079308.1|      DGGRISIAALAVGIAQGAFEAAALTYARERKQFGRPISYFQAIQFKLADMAMEIELARNMV
RAAC00816             DGGRVAIAALAVGIARAAFETALAYAKTRVQFGQAISKFQAIQHKLADMAMHIDLARNAV
                      ****::*.::.:  . * *  ***** *.******.*:**** * ref|YP_147450.1|      YKAAWLKDQGKPFTKEASFAKLFASEMGFRVCNQAIQIHGGYGYMKEYGVERHLRDIKLM
ref|YP_001125561.1|   YKAAWLKDQGKPFTKEASFAKLFASEMGFRVCNQAIQIHGGYGYMKEYGVERHLRDIKLM
ref|ZP_01696479.1|    YKAAWLKDQGKPFSKEAAYAKLFASEMGFRVCNQAIQIHGGSGYMREYGVERHLRDIKLM
ref|NP_241996.1|      LKAAWLKDQKKPFTKEGAYAKLYASETAMRTANQAIQIHGGYGYMQEYEVERMLRDAKLL
ref|YP_079308.1|      LKAAWLKDQGRPFTKEAAFAKLYASEMAFRTCNQSIQIHGGYGYMKEYGVERMLRDAKLM
RAAC00816             MKAAWLKDQGRPYTLEASYAKLFASEMCTRTCEQAIQILGGYGYMREYPVERHYRDAKLI
                      ******** :*: ::  *.::***:***    *...*:*** ** ***:** ***  :

ref|YP_147450.1|      EIGEGTSEIQRLVIARQLGC
ref|YP_001125561.1|   EIGEGTSEIQRLVIARQLGC
ref|ZP_01696479.1|    EIGEGTSEIQRLVIARKLGC
ref|NP_241996.1|      EIGEGTSEIQRMVIARQLGC
ref|YP_079308.1|      EIGEGTSEIQRLVIARQLG-
RAAC00816             EIGEGTSEIQRLVIARQLGC
                      ***********:****:**
```

FIG. 27

```
ref|NP_241073.1|        -----VLQTIKNHVAIITFNRPDQLNCFNYQMLLDLEQVIQEVKANPAIRTVIFTGAGGK
dbj|BAA75325.1|         -----VLQTIKNHVAIITFNRPDQLNCFNYQMLLDLEQVIQEVKANPAIRTVIFTGAGGK
ref|ZP_00539140.1|      -----------DHVAVIRVDRPERLNCFDYPTLVELKELVATVRREPDIRVVLFTGTG-K
ref|ZP_01696475.1|      ----------QDGIAVMTLNRSEAANALSKEMLSDMHEVLSEIKKDRSTRVVILTGAGEK
RAAC00822               MEQPIVWQKAEDGIAELLLNRPDAMNALNYALLRALEDAVREIAEDRGVRAVIVRGEG-K
ref|ZP_02130394.1|      MEEELVLSQTEDQVLTLTLNRPKVMNSFNFAMLHALKAAVDKARFDPEVRVIIITGAGDR
                              :    : ..:*..  *.:.   *   :. :       :  *.::.  * * :

ref|NP_241073.1|        SFSAGADLKERRTLDENQVRRNVNKIRSVFNQIEELPQPTIAAINGYALGGGFELALACD
dbj|BAA75325.1|         SFSAGADLKERRTLDENQVRRNVNKIRSVFNQIEELPQPTIAAINGYALGGGFELALACD
ref|ZP_00539140.1|      AFSAGADLKERVTLNETEVRRNVEMIRDVFADIARLPQPTIAAVNGHALGGGFEWMLACD
ref|ZP_01696475.1|      VFCAGADLKERKGMNEEEVLQAVRKIGAVVNETAALPQPVIAALNGSAFGGGLELALACD
RAAC00822               GFCAGADLKERRGLAPHEVRRNVRLTREAFDRVARLPQPTIAVLHGFAFGGGLELALACD
ref|ZP_02130394.1|      AFCAGADLKERATLTPVQVKEFIYTIRNLFTDIENLPKPVIAAVNGIALGGGTELALGCD
                         *.********    :   :* . :        .  **:*.**.::* *:*** *  *.**

ref|NP_241073.1|        FRLAVPEAKMGLTEVTWAIIPGAGGTQRLPRLIGSQRAKEMILTGRKVAAEEAQRLGIIL
dbj|BAA75325.1|         FRLAVPEAKMGLTEVTWAIISGAGGTQRLPRLIGSQRAKEMILTGRKVAAEEAQRLGIIL
ref|ZP_00539140.1|      FRIIVNGALVGLTETSFGIIPGAGGTQRLPRLIGETRAKEMIFTAKKIDAETAERYGIVS
ref|ZP_01696475.1|      LRIGAREAKYGLTETSLAIVPGAGGTQRLPRLIGVGKAKELIYTARRLTAEEAAAIG-LL
RAAC00822               FRIGSRDLRLGLTETSLAIVPGAGGTQRLARLIGPTWAKWMIFTAARIDAERARELGILL
ref|ZP_02130394.1|      IRLAAETAAMGLTETTLAIIPGAGGTQRLPRLIGKGKAKELIFTGRRVDAQEALDLGMVN
                         :*:         ****.: .*:.******** ****   ** :* *. :: *: *   * :

ref|NP_241073.1|        EVCDS-KHLLTEAVRLAEKMSV-NGPLAVIQAKYAIHYGCQTDLHTGLAIEAKAYETIIP
dbj|BAA75325.1|         EVCDS-KHLLTEAVRLAEKMSV-NGPLAVIQAKYAIHYGCQTDLHTGLAIEAKAYETIIP
ref|ZP_00539140.1|      RVVPTVEELMEVCLAFADEMLR-NGPIAIRQAKQAIDQGLDHTLSEGLKLETAAYETVIP
ref|ZP_01696475.1|      EYAVPRAAVIEKAFELAGEMQK-NGPIALRQAKTAIDQGTETGLSAGLKIEELAYNALIP
RAAC00822               EVADTREAAMDAARALARAIAE-NGPVAVRQAKWAIDRGLDVDLSTGLAIEDAAYEGVLP
ref|ZP_02130394.1|      KV-VPGDSLLDAAKDMAAAIRK-NGPIAVTQAKYAINQGMETDLSTGLAIESNAYWITIP
                         .       .     :   :*   :   ***:*;  * . *  :   * **  :*   ** :* ref|NP_241073.1|        TEDRLEALQAFKEKRPPQFKGK
dbj|BAA75325.1|         TEDRLEALQAFKEKRPPQFKGK
ref|ZP_00539140.1|      TEDRLEALRAFAEKRTPQFQGK
ref|ZP_01696475.1|      TEDRLEGLRAFAEKRTPVYKG-
RAAC00822               TSDRLEALAAFAEKRKPHFRGE
ref|ZP_02130394.1|      SKDRLEGLAAFREKRKPVYKGE
                         :.****.*  **  ***  *   ::*
```

FIG. 28A

```
ref|NP_389098.1|          -----KKTITING--VEMEASEEQTVLQLLNNSSIEVPQVCYHPSLGPIETCDTCIVSIN
ref|YP_091797.1|          MEMAEQKKITING--VEMEASEEQTVLQLLNNSSIEVPQICYHPSLGPIETCDTCIVSIN
ref|YP_001420821.1|       ---------TING--VEMEAPDGQTVLQLLNNSSIDVPHVCYHPSLGPIETCDTCIVNVN
ref|ZP_01171726.1|        -DLPDTYQVKLNGAEVKVAAGDETTILQLLQNSSVEVPNVCYHPSLGPIETCDTCIVSVN
ref|ZP_01696606.1|        ----------ING--QELAARKGQTILEVANAHDMYIPAICYHPNLGSIQTCDTCFVNVN
RAAC00950                 MSVDLKRTFTLDG--SPLTATEGETILQAMLAAGLDFPHICYHPALGPIETCDTCMVEVN
                                 ::*     :  * .  *:*:      .:  .* :** .*:*****:*.:* ref|NP_389098.1|          GELKRSCSAELKDGDVIDTLSPDVKKAQVIGMDKILYNHELYCTVCDYNNGGCEIHNTVK
ref|YP_091797.1|          GELKRSCSAEVKDGDVIDTLSPDVKKAQVIGMDKILYNHELYCTVCDYNNGGCEIHNTVK
ref|YP_001420821.1|       GELVRSCSAQIKDGDVIDTLSSDVKKAQIIGMDNILHNHELYCTVCDYNNGSCEVHNTVK
ref|ZP_01171726.1|        GELVRSCSTKLNDGDIIDTVSADVKEAQVIGMDRILTNHELYCTVCDYNNGGCEVHNTVK
ref|ZP_01696606.1|        GNLVRACATKVEPGMEVESGSKPVKDAQYEAMSRILKNHELYCTVCDNNNGNCVVHNTAE
RAAC00950                 GDLVRACATPVVEGMSVRTKSVAARYARKEAMDRILKNHDLYCTVCDNNNGNCVVHNTTM
                          *:*  *:*::    :  *   : *   .:  *: .*..** **:****** ***.* :***.

ref|NP_389098.1|          EMKINHQSIPFDHKPYHKDESHPFYRYDPDQCILCGRCVEACQDVQVTETLTIDWERKRP
ref|YP_091797.1|          EMKVNHQSIPFDQKPYHKDESNPFYRYDPDQCILCGRCVEACQDVQVTETLTIDWERKRP
ref|YP_001420821.1|       EMKINHQSIPFDQKPYPKDESNPFYRYDPDQCILCGRCVEACQDVQVTETLSIDWERKRP
ref|ZP_01171726.1|        EMKINHQSVPFAQKPYPADNSHPFYRYDPDQCILCGRCVEACQDVQVTETLTIDWEREKP
ref|ZP_01696606.1|        HLEIEHQKYQFEAKPYPPDQSHPFYRYEPDQCILCGRCVEACQDLQVNETLTIDWDREVP
RAAC00950                 AMDIDHQSYPFREKPYEVDMSHPFYRYDPSQCILCGRCVEACQNLQVSEVLSIDWDREIP
                          :.::**.  *   *** * *:*** .******::.*.*:***:*:  * ref|NP_389098.1|          RVIWDNDVPINESSCVSCGHCSTVCPCNAMMEKGMEGEAGYLTGINNETLRPMIEITKGV
ref|YP_091797.1|          RVIWDNDVPINESSCVSCGHCSTVCPCNAMMEKGMEGEAGYLTGIDDETLRPMIEITKGV
ref|YP_001420821.1|       RVIWDQDVPINESSCVSCGHCSTVCPCNAMMEKGMEGEAGYLTGINQETLRPMIDITKGV
ref|ZP_01171726.1|        RVIWDNDVPINESSCVSCGHCSTVCPCNAMLEKGMEGEAGYLTGIAKQTLRPMIEITKNV
ref|ZP_01696606.1|        RVIWDNDVPIDESSCVSCGHCVTVCPCNALMEKSMLGEAGYLTGIPQKVLEPMIDLTKEV
RAAC00950                 RVIWDNDVPINESSCVSCGHCVTVCPCNALMEKSMLGKAGFLTGIEPEPLQRMIDVTKAV
                          ***::*********.:.* *::** : *. :  * ref|NP_389098.1|          ETGYGSILAISDMESAMRDERIKKTKTVCTYCGVGCSFDVWTKGRDILKVEPQEEAPANG
ref|YP_091797.1|          ETGYGSILAISDMESAMRDERIKKTKTVCTYCGVGCSFDVWTKGRDILKVEPQAEAPANG
ref|YP_001420821.1|       ETGYGSILAISDMESAMRDERIKKTKTVCTYCGVGCSFDIWTKGRDILKVEPQPEAPANG
ref|ZP_01171726.1|        ETGYGSILAISDMEAAMRDERIKKTKTVCTYCGVGCSFDVWTKGREILKVDPQPEAPANG
ref|ZP_01696606.1|        EPGYKEIFAISEMEAAMRKSRIKRTKTVCTYCGVGCSFEIWTKGRHILKVEPQEHAPVNG
RAAC00950                 EPGYRAIFAISEIESHMRNSRIKRTKTVCTYCGVGCSFDIWTKDRDILKVEPQMEAPTNQ
                          *.**  *::***:*:  ..*:***********:*.*.***:  .**.* ref|NP_389098.1|          ISTCVKGKFGWDFVNSEERLTKPLIREGDHFREAEWEEALLLIASKFTELKEAFGPDSLA
ref|YP_091797.1|          ISTCVKGKFGWDFINSEERLTKPLIREGDHFREAEWEEALTLIASKFTDLKEEFGPDSLA
ref|YP_001420821.1|       ISTCVKGKFGWDFVNSEKRLTKPLIREGDSFREAEWDEALQLIADKFTDIKEHFGPDALA
ref|ZP_01171726.1|        ISTCVKGKFGWDFVNSEERLTKPLIREGEFFREAEWDEAISLIARRFTEIKNEHGAQAMS
ref|ZP_01696606.1|        ISTCVKGKFGWDFVNSEERLTKPLIRKGEEFVEASWDEALNLIASKLQEIKKQHGPDALG
RAAC00950                 ISTCVKGKFGWDFVNSPDRLTKPLIRKGDAFHEVSWDEALDFVAKRLTEIRQQYGDDAIA
                          *************:**  ********:*:  *  *.:***:  :*  ::  ::::  .*  :::.

ref|NP_389098.1|          FITSSKCTNEESYLMQKLARGVIGTNNVDNCSRYCQSPATAGLFRTVGYGGDSGSITDIA
ref|YP_091797.1|          FITSSKCTNEESYLMQKLARGIIGTNNVDNCSRYCQSPATAGLFRTVGYGGDSGSIADIA
ref|YP_001420821.1|       FITSSKCTNEESYVMQKLARAVIGTNNVDNCSRYCQSPATAGLFRTVGYGGDSGSITDIE
ref|ZP_01171726.1|        FISSSKCTNEESFLMQKLGRAVIGTNNIDNCSRYCQTPATVGLFRTVGYGGDAGSIRDIQ
ref|ZP_01696606.1|        FIASSKCSNEENYLFQKFARAIIGTNNLDNCSRYCQSPATSGLLRTVGIGGDSGTIRDIQ
RAAC00950                 LISSSKCTNEENYLMQKLARAVLHTNNIDNCSRYCQSPATEGLRRTMGYGGDTGSLHDLA
                          :*:****:***.::::**:.*.::: *** :********:****.:*   **  **:*  *:
```

FIG. 28B

```
ref|NP_389098.1|        QADLVLIIGSNTSESHPVLSTRIKRAHKLRGQKVIVADIRKHEMAERSDLFVQPRAGSDI
ref|YP_091797.1|        QADLVLIIGSNTSESHPVLSTRIKRAHKLRGQKVIVADIRKHEMAERSDLFVQPRAGSDI
ref|YP_001420821.1|     KAELVLIIGSNTSESHPVLSTRIKRSHKLHGQKLVVADLRKHEMAERSDVFFQPRAGSDI
ref|ZP_01171726.1|      MSDLVLIIGSNTAESHPVLSTRVKRSHKLGGQKLIVADLRKHEMADRADLFVQPKAGTDI
ref|ZP_01696606.1|      QADLVVTVGANPAESHPVLATRIKRAHKLHGQKLMVVDLRENELASRANLFIHSKPSTDL
RAAC00950               MADLLIIIGANPAESHPVFSTRMRRAKKKYGQKHIVIDLREHDMAHRADLFVRPNPGTDL
                        ::*::  :*:*.:*****::**::*::*    ***  :*  *:*::::* *:::*.:....:*:

ref|NP_389098.1|        VWLNAIAKYLIENGKADERFLRERVNGRDEYVKSLAPYTLEYAEEKTGIDQETLIQMAEM
ref|YP_091797.1|        VWLNAIAKYLIENGKADERFLQERVNGRDEYVKSLTPYTLEYAEEKTGIDQETLIQMAEM
ref|YP_001420821.1|     VWLNAVSKYLLDHDLADTSFLKERVNGLDEFVKSLEPYTMEYAEKHTGVDKDTLIKVARM
ref|ZP_01171726.1|      VWLSAVAKYIIDNGMADEEFLAEKVNGLDEFTKNLEKYTMEYAAEVTGIALEQLIDMAEM
ref|ZP_01696606.1|      IWLNAVTKYILDQGWEDKAFLEARVKGLDKFRASLEKYTLAFAEEKTGISKENLIKMATM
RAAC00950               VLISAVTRYIIDQGWHDADFVRDRVDGFEDFVRSLEPYTLEYAERVTGVPRDTVIQIATM
                        :  :.*:::*:::.   *  *:   :*.*  :.:  .*    **:   :*   .   **:     :  :*..:*  * ref|NP_389098.1|        IGQADSVCALWAMGVTQHIGGSDTSTAISNLLLVTGNYGKPGAGSYPLRGHNNVQGASDF
ref|YP_091797.1|        IGQADSVCALWAMGVTQHIGGSDTSTAISNLLLVTGNYGKPGAGSYPLRGHNNVQGASDF
ref|YP_001420821.1|     IHEAGSVCALWAMGVTQHIGGSDTSTAISNMLLVTGNYGKPGAGSYPLRGHNNVQGASDF
ref|ZP_01171726.1|      IGRAKSVCALWAMGITQHMGGSDASTAISNLLLVTGNYAKPGAGAYPLRGHNNVQGASDF
ref|ZP_01696606.1|      IHEAKSVCILWAMGITQHTCGTDASTAISNLLLVTGNYGRPGTGAYPLRGHNNVQGASDF
RAAC00950               IHEAKSTCICWAMGVTQHKGGSETSTAICNLLLVTGNVGRPGTGAYPLRGHNNVQGAGDM
                        *  .*  *.*  ****:***  *:::****.*:******  .:**:*:************  *:

ref|NP_389098.1|        GSMPDRLPGYEKVTDEQVRQKYERVWGVPLPKEPGMTNHEMIEKIHSGQLKAMYVKGEEM
ref|YP_091797.1|        GSMPDRLPGYEKVTDEQVRQKYEQAWGVPLPKEPGMTNHEMIEKIHSGKLKAMYVKGEEM
ref|YP_001420821.1|     GSMPDSFPGYEKVTDEKARKKYEQGWGTDLPKEIGMTNHEMIEGIHSGKLKSMYLKGEEM
ref|ZP_01171726.1|      GSMPNMFPGYQEVADPEIRKKYELAWGTELPGEPGLNNHEMVEGIHAGTLKAMYLKGEDM
ref|ZP_01696606.1|      GTMPAWFPGYEPVEDNEVREYEKAWGVKLPENPGLDNHQMIGGIKSGKLRGLYLFGEEM
RAAC00950               GCSPVYMPGYERVDDPAVRAKYETAWVVELPTSKGLDNHEMVDAIHEGKLRALIIQGEEM
                        *   *    :***: * *    * :**  *  .  **    *:  **:*:  *: * *:.: :  :  **:* ref|NP_389098.1|        GLVDSNINHVHAAYEKLDFFVVQDIFLSRTAEFADVVLPASPSLEKEGTFTNTERRIQRL
ref|YP_091797.1|        GLVDSNINHVHAAYEKLDFFVVQDIFFSRTAEFADVVLPASPSLEKEGTFTNTERRIQRL
ref|YP_001420821.1|     GLVDSNINHVHAAFEKLDFFVVQDIFLSRTAEFADVVLPASPSLEKEGTFTNTERRVQRL
ref|ZP_01171726.1|      GLVDSNINHVHAAFEKLDFFVVQDIFLSKTAQFADVILPASPSLEKEGTFTNTERRIQRL
ref|ZP_01696606.1|      AIVDSNINFVEEHLEKLDFFVVQDVFFSKTAQFADVILPASPSLEKEGTFTNTERRIQRF
RAAC00950               ALVDSNSHYVREAFAKLDLLVVIDVFFSKTAEYADVVLAASPSLEKEGTFTNTERRIQRL
                        ..:****   :.*.   ***:**  *:*:*:**::***:*.*:****************.**:

ref|NP_389098.1|        YQVFEPLGESKPDWQIIMEVANKLGAGWLYEHPADIMEEAAKLSPIYAGVTYERLEGYNS
ref|YP_091797.1|        YQVFEPLGESKPDWQIIMEVANKLGADWHYEHPADIMEEAAKLSPIYAGVTYERLEGYNS
ref|YP_001420821.1|     YEVFEPLGDSKPDWQIITDIANRLGADWHYEHPADIMEEAAMLSPLYAGVTYERLEGYNS
ref|ZP_01171726.1|      YQALEPLGDSKPDWQIIMEIANSLGAGWNYTHPSEIMEEASRLMPLYSGVTYERLEGFNS
ref|ZP_01696606.1|      YQVFEPMGESKPDWVIFQELANKMGAQWHYQHPGEIMAEAASLAKYFAGISYERLEGFNS
RAAC00950               YQVFEPLGESRPDWVILRDLANRLGANWTYAHPSEILEEMASLAALMQGVRWDRLEGYRS
                        *:..:**:*:*:***  *:   ::  :  *  *  **..:*:   *  :    *:   ::****:.* ref|NP_389098.1|        LQWPVNADGKDSPLLFTERFPFPDGKAILYPVQWTEPKEFGEEYDIHVNNGRLLEHFHEG
ref|YP_091797.1|        LQWPVSADGKDSPLLFTERFPFPDGKAILYPVHWTEPEEFGEEYDIHVNNGRLLEHFHEG
ref|YP_001420821.1|     LQWPVAADGTDSPLLFTDKFPFSDGKAILYPVQWTEPKEFDEEYDIHVNNGRLLEHFHEG
ref|ZP_01171726.1|      LQWPVAEDGQDTPLLYTERFPFEDGRARLVPVDWTKPLEFEEEYDLHINNGRLLEHFHEG
ref|ZP_01696606.1|      QIWPVKKDGTSTPLLYQDRFAFPDGKARLVPVDWEPPFSAGEGFDYHLNNGRLLEQFHEG
RAAC00950               LQWPVHPDGTDTPLLYTNGFPFPNGKARLVPARWIEPTAFEPEYDLHLNNGRMLEHFHEG
                        ***  **    .:***:   :  *.*  :*:*  *  *.    *     :* *:****:**:****
```

FIG. 28C

```
ref|NP_389098.1|            NLTYKSKGISEKTPEVFLEISPELAAERGIQDGTLVRLTSPFGNVKVKCLITDRVKGKEV
ref|YP_091797.1|            NLTYKSKGISKKTPEVFLEISPELAAERGIQDGTLVRLTSPFGNVKVKCLITDRVKGKEV
ref|YP_001420821.1|         NLTYRSKGISEKTPSVFLEVSPELAEERGLEDGTLVRLTSPYGNVKVKCVITDRVKGKQV
ref|ZP_01171726.1|          NMTYRSKGISEKTPSVFLEVSPELAEERGLESGTLVRLSSPYGNVKVQCHITDRVKGKEV
ref|ZP_01696606.1|          NLTDRSPGIHHKVPEPWLEISPEAASERGIKDGALVRLTSPYGKVKVRAVVTGRVQGKEL
RAAC00950                   NLTYRVHGLKEKVPTTYLEVSPELAKERGIETGALVRLISPYGELKLPVVVTDRVKGKQM
                            *:*   :   *: .*.*  :**:*** * ***::  *:**** **:*::*:    :*.**:**::

ref|NP_389098.1|            YLPMNDSG-EAAINLLTGSHADKDTDTPAYKETSAKMEILKHDGISPLPKINHRNGNPQP
ref|YP_091797.1|            YLPMNDSG-EAAINLLTGSHADKDTDTPAYKETSAKMEILKRDGSNPLPKINHRNGNPQP
ref|YP_001420821.1|         YLPMNDSKD-AAINLLTSSYADKDTDTPAYKETSAKMEILKKEGVNPLPKINFRYGNPQP
ref|ZP_01171726.1|          YLPMN-DRGEAAINLLTSSYADKDTDTPAYKEIRAKMEILKAKGEDPLPRINHRYGNPQP
ref|ZP_01696606.1|          YLTMNARKEDEMVNRLTSSYHDRVTHTPNYKEMGVKMEILEEKGKPPLPKVNHRYGNRIP
RAAC00950                   YLPMNTSNDEEAINILTSSESDETTHTPAYKELQVRMEVIRPRGESPMTRFNFRMHRPNP
                            .           :* **.*  *.  *. *   .:**::.    *  *:.:.*.*   .  * ref|NP_389098.1|            QIGVQVHKKWARKDYIFPGDAVK------
ref|YP_091797.1|            QIGVQVQKKWARKDYIFPGDAVK------
ref|YP_001420821.1|         QIGVRVDRKWARKDYVFPGDAVK------
ref|ZP_01171726.1|          QIGVQVQKKWARKDYIFPGDLVKKEREHG
ref|ZP_01696606.1|          QISVRVEEKWKRDDFIPI-----------
RAAC00950                   QSGVRVERKWSRGYVPVAEAAKEKARG-
                            * .*:*..**  *  .::
```

FIG. 29

```
ref|YP_146314.1|           --------GFAAKRRPIAKYRNGRFVEEEDEIALEFPLTITVNGEEFATIVCTPAHLDEL
ref|YP_001124593.1|        --------GFVAKRRYIVKYRNGQLAEKEDEIALEFPLTVVVNGQEFATIVCTPGHIDEL
ref|NP_391552.1|           -----------TAVRDVWRYEQGEISKVEDRMVTEFPLTVILNGSEFVTLVCTPEHIEEL
RAAC00952                  MNGVSRFGGAETRRRFVLRYRSGEYRQEEDVIATEFALTLFVNGEEFSTLVCTPTYAEDL
ref|NP_830405.1|           ---------------IVRYQSGTFSKQLDEIVTESPITIKLNGEEYVTVVCTPNYIEDM
ref|ZP_00739906.1|         ---------------IVRYQSGTFSKQLDEIVTESPITIKLNGEEYVTVVCTPNYIEDM
                                           : :*..*   :  * :. * .:*: :**.*: *:****  :  :::

ref|YP_146314.1|           VIGFLASEGAIRTCSDIKGMTIDGERGFAYVELAAGGLPAKQFYAKRFIGSCCGKSRQ-F
ref|YP_001124593.1|        VIGFLASEGVIRVIDDIKAMTIDGERGFVYVELTSDELPAKQFYAKRFIGSCCGKSRQ-F
ref|NP_391552.1|           VIGFLASEGVIRFQKEIKRFTIDESLGFVYVDLVHPETLDQKDYTKRVIGSCCGKGRH-F
RAAC00952                  VYGFLASEGVIRDVDDVESIRVSLWTGTARVQTKSGAVLSPALYNKRYIGSCCGKGRQSF
ref|NP_830405.1|           VIGFLISEGIISSYNDVEELWVQKDNGIVHVKSSKVNPLYQTLYNKRYVTSCCGKGRQGF
ref|ZP_00739906.1|         VIGFLISEGIISSYKDVEELWVQKDNGIVHVKSSKVNPLYQTLYNKRYITSCCGKGRQGF
                           * * * *    .::: : :.     * .*.           *   :**.*: * ref|YP_146314.1|           YFYNDMKTAKTIVG-GITVKADDCIRLMKALHERSTDFAATGGLHNAALATPDEMVVIRS
ref|YP_001124593.1|        YFYNDAKTAKTIVG-GITVKADDCVCLMKTLHEQSIDFAATGGLHNAALATPDRIVVIRS
ref|NP_391552.1|           YFQQDVKTAKTAVS-QIKISPEACLALMKDMQQGSGTFQDTGGVHNAALCDTEKLLLMRT
RAAC00952                  YFQSDALTARPVED-PVSLSADDVFRAMDLLDASSGLFEETGGVHVAALVREGQLVLARA
ref|NP_830405.1|           IFVNDAAKAKDLHDIHVKITPEECFYLMNTLQQSSTTFRQTGGVHNTALCDRNKILLSRM
ref|ZP_00739906.1|         IFVNDAAKAKDLHDIHVKITPEECFHLMNTLQQSSTTFRQTGGVHNTALCDRNNILLSRM
                            * .*   .*:    .  :.:..:  .  *. :.  *   *  ***:*  :**   .::: * ref|YP_146314.1|           DIGRHNALDKLYGYCLRHQVAMKDKLIVFSGRVSSEVLLKAAKMGVSVLLSKSAPTTLAL
ref|YP_001124593.1|        DIGRHNALDKLYGYCLRHQVAMKDKLIVFSGRVSSEVLLKAAKMGISILLSKSAPTTLAL
ref|NP_391552.1|           DIGRHNALDKLYGHCLLNGMSVRDKLIVFSGRISSEVLLKAAKIGVSIVISKSAPTELAI
RAAC00952                  DIGRHNALDKIYGHCLRAGERLSGTAVAFSGRISSEVLLKVAKIGVGVVIARGAPTLLAV
ref|NP_830405.1|           DIGRHNALDKIYGHCLRNDISVKGKIIAFSGRISSEILLKVSKIGCEIVLSKSAPTKLAL
ref|ZP_00739906.1|         DIGRHNALDKIYGHCLRNDISIKGKIIAFSGRISSEILLKVSKIGCEIVLSKSAPTKLAL
                           **********:**:**    :  .. :.****:***:***.:*:*  ::::::.*** **:

ref|YP_146314.1|           DLADELGITVVGFLRGQAFNVYTHESRI-------------
ref|YP_001124593.1|        DLAEELGITVVGFLRGQDFNVYTHEKRI-------------
ref|NP_391552.1|           QMAEELNITAIGFVRNGSFNVYTHPERIRE-----------
RAAC00952                  DLAEELNITAIGFVRGRAFNVYSHPWRLADAKKAQGAIEGA
ref|NP_830405.1|           QLAHDLGITVVGFIRNESCNIYTHPHRI-------------
ref|ZP_00739906.1|         QLAHDLGITVVGFIRNESCNIYTHPKRI-------------
                           ::*.:*.**.:**:**:*.    *:*:*   *:
```

FIG. 30

```
ref|YP_148038.1|          -------------IRIAIAGPRGRMGREAVALVQQTDHFELAAVIDRRYDGQNLAEIDGF
ref|YP_001126216.1|       -------------IRIVIAGPRGRMGREAVALVQRTDHFELAAVIDRRYDGQNLADIDGF
ref|NP_242546.1|          -------------IKVAVAGPRGKMGREAVKMIHEADTLELVAVVDSKHDGMLVRQLDGL
ref|YP_175412.1|          -------------RIVIAGPRGNMGQEAVKLCLREESFELVAVVDSKNDGKQLKGLQEF
ref|ZP_01697215.1|        -------------IRIIVAGARGKMGSEAVRLIERTEHFKLVGVVDRTFDGKLFNDVSDY
RAAC00990                 MAKGGERMDKAGGIRVALAGALGRMGQVALEALRREDDIAICGVLVRRADEEAERRLSTY
                                       ::  :**. *.** *:     . : :  .*:    *       :.

ref|YP_148038.1|          SGVNAPIYTDAARCFAEVKPDVLIDLTTPEAGKRHTELALRYGVRPVVGTTGFTPEDIER
ref|YP_001126216.1|       AGIDAPIYTDAVRCFTEVKPDVLIDLTTPEVGKRHAELALRYGVRPVIGTTGFTPEDIER
ref|NP_242546.1|          PPSDAPVYNELERCLTSQTIDVLVDLTTPAHGKRHMEIALDHGVRPVVGTTGFTDEDITN
ref|YP_175412.1|          QQGDVPVYTDMARCFAEHEPDVLIDLTAPAFGRKHMEVAFEHGVRPVVGTTGFSDEDIRD
ref|ZP_01697215.1|        NGEPVRVYTDPEACLENCPADVWIDLTVPKAGFLHAKTALAHGVRPVVGTTGFTDAELEE
RAAC00990                 G----AVYDDPERLIDTEEPDVWVDLTGPASVVRHVDLALSRGVRAVVGATGYTDEDVRR
                              :*  :      :   **  :***  *    * . *:  ***.*:*:**::  ::

ref|YP_148038.1|          LTKLAEEKEIGAIIAPNFAVGAVLMMKFARMAAKYFTDVEIIELHHDQKLDAPSGTALKT
ref|YP_001126216.1|       LTELAETNEIGAIIAPNFAVGAVLMMKFARMAAKYFTDVEIIELHHDQKLDAPSGTALKT
ref|NP_242546.1|          LRKKAEEKGIGAIIAPNFAIGAILMMKFAQTAAKYLPDVEIIEMHHDRKLDAPSGTALKT
ref|YP_175412.1|          LTKLAEAKELGAIIAPNFAIGAILMMKFAQTAARYMNDVEIIEQHHDRKLDAPSGTAVKT
ref|ZP_01697215.1|        LKAVSAQKGIGCIIAPNFAIGAVLMMKFAQMAAKYFPDVEIIELHHDRKKDAPSGTSVKT
RAAC00990                 WDEMARHRQVGAAVCPNFAIGALLMMRFAREAARFLPRAEIIELHHDGKRDKPSGTSLRT
                            :  .  :*. :.**::*:;    .** * * * ****:::* ref|YP_148038.1|          AQLIAEVRPSKKQGHPNEKETLAGARGAEYDGIPIHSVRLPGFVAHQEVIFGGNGQTLTI
ref|YP_001126216.1|       AQLIAEVRPSKKQGHPDEKETLAGARGAAYDGIPIHSVRLPGFVAHQEVIFGGEGQTLTI
ref|NP_242546.1|          AQLISEVRKAKQQGHPDETEELKGKARGADFEGMSIHSVRLPGLVAHQEVLFGGVGQTLKI
ref|YP_175412.1|          AQLIAEVRAPKKQGHEQEREEMAGARGADFDGMKIHSVRLPGRVAHQEVLFGGVGQTLSI
ref|ZP_01697215.1|        AQMISEARRKKTQGHPDEKETLQGARGADFEGMHIHSVRLPGLVAHQEVLFGGDGQLLTI
RAAC00990                 KAMM-------------------EVEYD-VPIHSVRLPGLVAHQEVIFGGAGEVLTI
                           ::                       . :: : ***** **:* *: *.* ref|YP_148038.1|          RHDSFDRRSFMSGVKLAVETVMHLHTLVYGLEHIL-
ref|YP_001126216.1|       RHDSLDRRSFMSGVKLAVETVMHLHTLVYGLEHIL-
ref|NP_242546.1|          RHDSMNRESFMPGVKLSIETVMGIDTLVYGLENII-
ref|YP_175412.1|          RHDSLNRESFMPGVKLAVEQVVKLSTLVYGLENLI-
ref|ZP_01697215.1|        RHDSMDRASFMSGVKVAVETVMNLNTFVYGLENIL-
RAAC00990                 RHDSLSRESFMPGLILAVRRVMTLRALVYGLDKLLW
                          ****:.* ***.*: :::. *: : ::****::::
```

FIG. 31

```
ref|YP_704478.1|         --------MTKASVAIVGSGNISTDLLYKLQRSEWLEPRWMIGIDPESEGLARARKLGLE
ref|YP_879906.2|         ----------KAKVAIVGSGNISTDLLYKLLRSDWLEPRWMVGIDPQSEGLARARKLGLE
ref|YP_890165.1|         ----------KKSSVAIVGSGNISTDLLYKLLRSEWLEPRWMIGIDPESEGLARARKLGLE
ref|YP_956012.1|         ----------KKSVAIVGSGNISTDLLYKLLRSEWLEPRWMIGIDPESEGLARARKLGLE
ref|YP_001132791.1|      ----------KLSVAIVGSGNISTDLLYKLLRSEWLEPRWMIGIDPESEGLARARKLGLE
RAAC01029                MGERRGFGLKKLSAAIVGSGNIGTDLMIKLKRSPWIEPRWMIGIDPESDGLRRAREMGLE
                             ..******.*:   *::***:**:*: *.::*** ref|YP_704478.1|         TSAEGVDWLLNQPEKPDLVFEATSAYVHREAAPRYEAAGIRAVDLTPAAVGPAVVPPANL
ref|YP_879906.2|         TTHEGVDWLLAQPEKPDLVFEATSAYVHRDAAPKYEAAGIRAIDLTPAAVGPAVIPPANL
ref|YP_890165.1|         TSAEGVDWLLAQSEKPDLVFEATSAYVHRDAAPRYEEAGIRAIDLTPAAVGPVVPPANL
ref|YP_956012.1|         TSHEGVDWLLAQSELPDMVFEATSAYVHKAAAPRYAEAGIRAIDLTPAAVGPGVIPPANL
ref|YP_001132791.1|      TSHEGVDWLLARDEKPDMVFEATSAYVHRDAAPRYAEAGIRAIDLTPAAIGPGVIPPANL
RAAC01029                TSADGLKAVLEQGVRPDIVFDATSAKAHVRHAKLLREAGIQAVDLTPAARGPYVIAAVNL
                         *: :*:.  :* :   **:**:****  .*   *    ***:*:****** ** *:...**

ref|YP_704478.1|         REHLGAPNVNMITCGGQATIPIVYAVSRVVDVPYAEIVASVASVSAGPGTRANIDEFTKT
ref|YP_879906.2|         RQHLDAPNVNMITCGGQATIPIVYAVSRVVEVPYAEIVASVASVSAGPGTRANIDEFTKT
ref|YP_890165.1|         RDHLDAPNVNMVTCGGQATIPIVHAVSRVVDVPYAEIVASVSSASAGPGTRANIDEFTKT
ref|YP_956012.1|         RAHLDAPNVNMVTCGGQATIPMVYAVSRVVEVPYAEIVASVSSASAGPGTRANIDEFTKT
ref|YP_001132791.1|      REHLDAPNVNMVTCGGQATIPMVHAVSRVVDVPYAEIVASVSSASAGPGTRANIDEFTKT
RAAC01029                EEHLDSPNVNMVTCGGQATVPMVYAVSRVVGVRYAEIVATIASKSAGPGTRANIDEFTQT
                         . .:*:*****:*:*:****** * ******:::.* **************:* ref|YP_704478.1|         TSRGIETIGGAQRGKAIIILNPADPPMIMRDTIFCAIPEDAD---RAAITDSIHRVVADI
ref|YP_879906.2|         TSRGVETIGGAKRGKAIIILNPADPPMIMRDTIFCAIPEDAD---RDAIAQSIHDVVKEV
ref|YP_890165.1|         TSAGVQNIGGAQRGKAIIVLNPAEPPMIMRDTIFCAIPEGA---DHDAITQSIKDVVAEV
ref|YP_956012.1|         TSAGVQNIGGAQRGKAIIILNPAEPPMIMRDTIFCAIPEHA---DHAAITQSIKDVVAEV
ref|YP_001132791.1|      TSAGVEVIGGARRGKAIIILNPADPPMIMRDTIFCAIPEDAD---HAAITQSVKDVVAEV
RAAC01029                TARALEAIGGAKRGKAIIILNPAEPPILMRDTIYCLMEDASP-TTQAKVLESIEQMVRHV
                         *: .:: **** :******.*****:**:::****:* : : :    :  : :*:.. :* .:

ref|YP_704478.1|         QQYVPGYRLLNEPQFDDPSVVSGGQATVTTFVEVEGAGDFLPPYAGNLDIMTAAATKVGE
ref|YP_879906.2|         QSYVPGYRLLNEPQFDDPSLNSGGQALVTTFVEVEGAGDYLPPYAGNLDIMTAAATKVGE
ref|YP_890165.1|         QTYVPGYRLLNEPQFDEPSVVNGGNHLVTTFVEVEGAGDYLPPYAGNLDIMTAAATKVGE
ref|YP_956012.1|         QTYVPGYRLLNEPQFDEPSVVNGGNHVVTVFVEVEGAGDYLPPYAGNLDIMTAAATKVGE
ref|YP_001132791.1|      QTYVPGYRLLNEPQFDEPSVVNGGNHLVTIFVEVEGAGDYLPPYAGNLDIMTAAAAKVGE
RAAC01029                QTFVPGYRLNREPIFQD--------DLVSISIEVEGLGDYLPVYAGNLDIMTAAAVKFGE
                         * :****** .** *::         *: :**** **:** *************.*.**

ref|YP_704478.1|         EIAQKLLSV-------
ref|YP_879906.2|         EIAKETLSVA------
ref|YP_890165.1|         EIAKKSAEASLASGAQ
ref|YP_956012.1|         EIAKESL---------
ref|YP_001132791.1|      EIARERVATST-----
RAAC01029                EYARHKMQVASAEEAR
                         *  *:.
```

FIG. 32A

```
ref|YP_519313.1|      ------------------------------------------MSKKFVYLFREGQASM
ref|ZP_01370069.1|    ------------------------------------------MSKKFVYLFREGQASM
ref|YP_359304.1|      ------------------------------------------TKYVYLFHEGRADM
ref|YP_429480.1|      -------------------------------------------KYVYLFSEGKADM
ref|ZP_01697277.1|    ------------------------------------------TKFVYLFNEGNSHM
RAAC01041             MSHGELAASARRPMCKRFAGWATRRPRQGGCKMAQVQDVQRDQALTTRWVYSFDQADPKN
                                                                ::** *  :. .

ref|YP_519313.1|      RDLLGGKGANLAEMTNIGLPVPPGFTITTEACNDYYALGRNLPEGLWEQIGPALGDIEKA
ref|ZP_01370069.1|    RDLLGGKGANLAEMTNIGLPVPPGFTITTEACNDYYALGRNLPEGLWEQIGPALGDIEKA
ref|YP_359304.1|      KDLLGGKGANLAEMTNIGLPVPPGMTITTEACREYYRLGGKFPEGLMEEVKEKLVYIEEK
ref|YP_429480.1|      RLLLGGKGANLAEMTNIGLPVPQGITITCEACNEYNRLGQQFPEGLEEEVAARLKDLEAI
ref|ZP_01697277.1|    RDLLGGKGANLAEMTNIGLPVPFGFTITTEACNDYYSNGKKISDAVETQMEEALLKLEEK
RAAC01041             RSLLGGKGANLAQMVQWGFPVPPGFTITTEACNEYWARGGKFPEGLLDEVALAILRLERT
                      : **********:*.: *:*** *:* *.:*  * ::.:.:  ::    :  :* ref|YP_519313.1|      TGKKFGDKDNPLLVSVRSGAKFSMPGMMDTILNLGLNDETVEGLAASTQNARFAYDSYRR
ref|ZP_01370069.1|    TGKKFGDKDNPLLVSVRSGAKFSMPGMMDTILNLGLNDETVEGLAASTQNARFAYDSYRR
ref|YP_359304.1|      TGKKFGDPQNPLLVSVRSGAKFSMPGMMDTILNLGLNEETVEGLAQNTQNPRFAYDAYRR
ref|YP_429480.1|      NGKKLGDPENPLLVSVRSGAPVSMPGMMDTILNLGLNDNSVKGLAAQTGDERFALDCYRR
ref|ZP_01697277.1|    TGKKLGGNENPLLVSVRSGSVFSMPGMMDTVLNLGMNDETVEAVAKLTGNPRFAYDSYRR
RAAC01041             AGKRFGDAFQPLLVSVRSGAPVSMPGMMDTILNLGLNDLTVRALANQSQDPAFAYDSYRR
                       **::*.  :******: .***:**:*  :*...:*   : :  ** *.*** ref|YP_519313.1|      FIQMFGDVVLEVEHHEFERILEEAKEKQNVNYDSELTAESLKGVVEGYKRLIQRRTGSPF
ref|ZP_01370069.1|    FIQMFGDVVLEVEHHEFERILEEAKEKQNVNYDSELTAESLKGVVEGYKRLIQRRTGSPF
ref|YP_359304.1|      FIQMFGDVVLEIPKHEFEHILDRQKEKEGVTFDQELSAEAALKEVITRYKELVERKTGKPF
ref|YP_429480.1|      FIQMFGNVVLGIEHNDFEAVLEKHKERLGVKFDHELTPDALREVIAEYKDVVKSRSGRDF
ref|ZP_01697277.1|    FIQMFSDVVLGIEVYHFEHLLEQTREQKGYTADPEMTAEDWKDIIAGYKKIVKKHTKQDF
RAAC01041             LIQMFANVVFNVSLEPFEHALRAAKAKHGVERDRDLPADAWKDLVATYLKLFAEHVGQPF
                      :**..:: :   **  *   : :.   * ::..:  :  :: *  :. :     * ref|YP_519313.1|      PLDPMKQLEQAILAVFRSWNNDRAIVYRRINSIPDNIGTAVNVQSMVFGNMGNDSGTGVA
ref|ZP_01370069.1|    PLEPMKQLEQAILAVFRSWNNDRAIVYRRINSIPDNIGTAVNVQSMVFGNMGNDSGTGVA
ref|YP_359304.1|      PSDPMVQLTMAIEAVFRKSWNNDRAIVYRNLNHIPHDLGTAVNIQSMVFGNMGNDSGTGVA
ref|YP_429480.1|      PQDPREQLYMAIRAVFDSWNNPRAIVYRKINKIPDDLGTAVNVQTMAFGNMGPTSGTGVA
ref|ZP_01697277.1|    PQDPKTQLYLAVNAVFDSWNNQRAIVYRRLNKIPDHLGTAVNIQSMVFGNMGDDSGTGVA
RAAC01041             PQDVNVQLELAIEAVFRSWNSPRAIVYRKAHGIPETLGTAVNVQAMVFGNMGDDSGTGVI
                      * :   **  *:  * *.  **** :  :. :*****:*:*.**  *** ref|YP_519313.1|      FTRNPSTGERVLYGEYLMNAQGEDVVAGIRTPQPIKSLEDENKAIYAQFVETSNSLEAHY
ref|ZP_01370069.1|    FTRNPSTGERVLYGEYLMNAQGEDVVAGIRTPQPIKSLEDENQAIYAQFVKTSNSLEAHY
ref|YP_359304.1|      FTRNPSTGEKVLYGEYLTNAQGEDVVAGIRTPSPISKLEEMPEVYEQFVSIAKLLESHY
ref|YP_429480.1|      FTRNPSTGEKGIYGEYLINAQGEDVVAGIRTPKPISSLKEEMPEVYRQFEDICQLLEKHY
ref|ZP_01697277.1|    FTRNPSTGERVLYGEYLINAQGEDVVAGIRTPQPIQVLAKDMPEVYRQFVKTSKLLEEHY
RAAC01041             FTRHPSTGEPVLFGEFLANAQGEDVVAGIRTPQPIADLAHTMPHVYESLVALAKQLETRF
                      ***:*****    :::**:*  **************:**      :*  .:    .: ** ::

ref|YP_519313.1|      RDMQDIEFTIERGRLYILQTRNGKRTAPAAIRVAVELCREGVISKEEAIARIEPGQLDQL
ref|ZP_01370069.1|    RDMQDIEFTIERGRLYILQTRNGKRTAPAAIRVAVELCREGVISKEEAIARIEPGQLDQL
ref|YP_359304.1|      KNMQDIEFTIERGKLYILQTRNGKRTAQAAVKIAHDMVEEGLITKKEAILMVEPGQLDQL
ref|YP_429480.1|      RDMQDIEFTIEKGKLFILQTRNGKRTAAAAVKIAVDMVNEGLITKEEAVLRVDADQLIQL
ref|ZP_01697277.1|    QDMQDIEFTVERGKLYLLQTRNGKRTAQAAIRIAVEMVKEGILDKKTALLRVDPDQMNQL
RAAC01041             RDMQDVEFTVERGKLFVLQTRSGKRTAQAAVRIAIDMLHEGLIQPEEALLRVDAQHLRQL
                      ::***:***:*:*:* ::****.***** **::** ::*  .**::    : *:   :: **
```

FIG. 32B

```
ref|YP_519313.1|      LHRRMDSEAKLEVIAKGLPASPGAASGKIVFDADEAERLGHTGERVLLVRTETTPDDIHG
ref|ZP_01370069.1|    LHRRMDSEAKLEVIAKGLPASPGAASGKIVFDADEAERLGHTGEKVLLVRTETTPDDIHG
ref|YP_359304.1|      LHRQIDPSAKVEVIAKGLPASPGAASGIVVFDADEAEKLGKEGKKVLLVRTETTPDDIHG
ref|YP_429480.1|      MHRRIDPSAKLEVVAKGLPASPGAASGQVVFDADDAEKMGLDGQKVVLVRTETTPDDIHG
ref|ZP_01697277.1|    LHRRIDGSATKNHLAKGLPASPGAATGTVVFDADEAERLGKEGEKVILVRPETTPDDIHG
RAAC01041             LHRRLQGTDALQVFAKGLPASPGASVGRIVLDADTAVEWAQRGEKVVLVRPETTPEDIHG
                      :**:::       :  .**********:  * :*:***  *  . . *::*:*** .****:****

ref|YP_519313.1|      ILAAQGILTSRGGMTSHAAVVARHMGKPAVCGCEALRIDYAHNTVTIDGVTYPEGTLFSI
ref|ZP_01370069.1|    ILAAQGILTSRGGMTSHAAVVARHMGKPAVCGCEALRIDYAHNTVTIDGVTYPEGTLFSI
ref|YP_359304.1|      IVAAQGVLTSRGGMTSHAAVVARGMGKPCVCGCEAIKIDYEKKLFTVDNITVKEGDYLSI
ref|YP_429480.1|      IVQAQGVLTARGGMTSHAAVVARGMGKPAVTGCDAIKIDVENKRFFIGDLVVKEGDVISI
ref|ZP_01697277.1|    IVASQAVVTSRGGMTSHAAVVARGMGKACICGCESMKIDLKAKQFTVGDTVVRYGDVITI
RAAC01041             VLAAEGVVTTHGGMTSHAAVVARGIGKPAVCGCDGVHIDFEARQVESNGVVLKEGDVISV
                      ::   :: .::*::************  :**..:  **:.::**       . .  ..  *  :::

ref|YP_519313.1|      DGTTGRVIKGAVPMIDPELSEEFKELLGWADEIRTLKVLANADNPRDAQKARDFGAQGIG
ref|ZP_01370069.1|    DGTTGRVIKGAVPMIDPELSEEFKELLGWADEIRTLKVLANADNPRDAQKARDFGAQGIG
ref|YP_359304.1|      DGSTGRVILGTVPMKDPELSPEFIKLLEWADELKRLEVRANADTPEDAQKAREFGAKGIG
ref|YP_429480.1|      DGSTGNVMLGEVPLIDPQLTGEFETILEWADSFRRLKVRANADTPEDARRSREFGADGIG
ref|ZP_01697277.1|    DGSTGEVMLGEVPMIDPELSGEFKTLLEWADEVRDLGVRANADNPTDAKKSLEFGADGIG
RAAC01041             DGGTGTVYVGEAQMEEAKMADELKELLSIADQVRRLKVRANADTPEDARRAREFGAEGIG
                        *  *   : :.::: *:  :*  **..:  *  *.****.* ::: :*.*** ref|YP_519313.1|      LCRTEHMFMDPARIPIVQEMILAQTLPEREVALAKLLPMQEEDFYGILKVMAGFPVTIRL
ref|ZP_01370069.1|    LCRTEHMFMDPARIPIVQEMILAQTLPEREVALAKLLPMQEEDFYGILKVMAGFPVTIRL
ref|YP_359304.1|      LCRTEHMFMGPERLPHVQRMILAETKEEREEALSHLLPMQEEDFYGILKAMEGYPVCIRL
ref|YP_429480.1|      LTRTEHMFMQVDRLPVVQQMILAKTKEERQAALDKLLPMQQGDFYGILKAMEGLPVTIRL
ref|ZP_01697277.1|    LCRTEHMFMDIKRVPIVQEMILAETLEEREKALDKLLPMQQGDFEGIFEEMAGHPVTIRL
RAAC01041             LCRTEHMFLSPDRVPLVQRMILATTSAERQAALSKLLPLQVSDFTAIFEAMDGLPVTIRL
                      * ******:       *:* .**  *  :  :***:*   **  .*:: *  *  * ref|YP_519313.1|      LDPPLHEFLPNVEELVVDITKLKLQGDREEELNEKEVLLRKVRALSEMNPMLGHRGCRLG
ref|ZP_01370069.1|    LDPPLHEFLPNVEELVVDITKLKLQGDREEELNEKEVLLRKVRALSEMNPMLGHRGCRLG
ref|YP_359304.1|      LDPPLHEFLPSLEELLVETTELRVRGDNPELLAEKEALLKKVKSLHEFNPMLGHRGCRLG
ref|YP_429480.1|      LDPPLHEFLPNIEELLVDVTRLQATNGDSKELEEKQALLREVRARHEFNPMLGHRGCRLG
ref|ZP_01697277.1|    LDPPMHEFLPDKEELLVEVTKLQLTAPESKELEEKEYLLKKVQHLAEFNPMLGHRGCRLG
RAAC01041             LDPPLHEFLPREEELAERLEELRAQGASEDEIAETEQLLRQARYLREANPMMGLRGSRLG
                      **:*  *     .*:      .  : *:  *.: ::*:.:   *  *** :*  .* ref|YP_519313.1|      ITFPEIYAMQARAIFQASARLVKEGCEIHPEVMIPLVIHVKELAKLRKVTEEAAQTVMAE
ref|ZP_01370069.1|    ITFPEIYAMQARAIFQAAARLVKEGYEIYPEVMIPLVIHVKELAKLRKVTEEAAQTVMAE
ref|YP_359304.1|      ITYPEVYEMQIRAIFNAAARLTKEGYKVYPEVEIPLTIDVNEMKFFKERIDAIAREVMER
ref|YP_429480.1|      ITYPEIYAMQVRAIFQAVAQLVKEGVKVLPEVEIPLVIHVNELQRLHAMVDEVAAAVKKE
ref|ZP_01697277.1|    VIFPEIYEMQVKAIFYAAAAVLQKGIKVQPEIMIPLVGHVNELKRMRALVTDMANQVMEE
RAAC01041             IVYPEIYDMQMEAIITAAAQAKRRGIAVDLEVMLPLIGSPKELRVLRERMEEIAKRTMER
                      : :**:*  **  **: *    :.*  :  *:  :**  :*:  ::  *  . .

ref|YP_519313.1|      QGVTFSYTIGTMIEVPRAALTADEVATAADFFSFGTNDLTQTTLGFSRDDAEGKFLPAYL
ref|ZP_01370069.1|    QGVTFAYTIGTMIEVPRAALTADEVATAADFFSFGTNDLTQTTLGFSRDDAEGKFLPAYL
ref|YP_359304.1|      EGVTFHYTTGTMIELPRAALLADELAEVAEFFSFGTNDLTQTTLGFSRDDAEGKFLTHYL
ref|YP_429480.1|      TGVDFDYKVGTMIEMPRACATADEIAREAEFFSFGTNDLTQTTFGFSRDDAEGKFLHQYV
ref|ZP_01697277.1|    KGLKFDYTVGTMIEIPRAALTADQIAEEADFFSFGTNDLTQTTFGFSRDDAEGKFLQQYI
RAAC01041             EGVEIEYRIGTMIEVPRAALTADQIAEDAQFFSFGTNDLTQMTFAFSRDDAEGKFLNVYL
                      *:  : *   *****:***.  **::*  *:***********  *:.***********     *:
```

FIG. 32C

```
ref|YP_519313.1|      EQNILEHNPFAVLDRIGVGKLMKMGVQLGREANPGLKVGICGEHGGDPSSIEFCHQIGLN
ref|ZP_01370069.1|    EQNILEHNPFAVLDRIGVGKLMKMGVQLGREANPGLKVGICGEHGGDPSSIEFCHQIGLN
ref|YP_359304.1|      DMKILKENPFIVLDRKGVGKLMKIAVEGGRKTRPDLLVGICGEHGGEPSSVEFCHQIGLD
ref|YP_429480.1|      DEKILKEDPFIVLDRDGVGKFMKMAVELGRSTNPKLEIGICGEHGGEPSSVEFCHQIGLN
ref|ZP_01697277.1|    EQKVLPENPFAVLDQEGVGKLVETGVKLGRQTKPGLKTGICGEHGGEKSSIEFCYKTGLN
RAAC01041             DREILPYNPFETLDTEGVGKLIQWAVEAGRKRRPDLKTGVCGEHGGDPASIAFCEDIGLD
                      :  ::*   :**  .**    ****:::  .*: **. .* *  *:******: :*: ** . **:

ref|YP_519313.1|      YVSCSPF--------------------
ref|ZP_01370069.1|    YVSCSPF--------------------
ref|YP_359304.1|      FVSCSPY--------------------
ref|YP_429480.1|      YVSCSPF--------------------
ref|ZP_01697277.1|    YVSCSPY--------------------
RAAC01041             YVSCSPFRIPVARIAAAQAAVRKRMTG
                      :*****:
```

FIG. 33A

```
ref|ZP_01697463.1|     ---IQKAAVIGSGVMGSGIAAHLANIGIPVLLLDIVPNALTEAEKAKGYTLEDKAVRNRF
ref|ZP_01173543.1|     IQQIKKAAVLGSGVMGSGIAAHLANIGIPTLLLDIVPRELNEAEQKKGLTLEDKAVRNRI
ref|NP_244355.1|       -RQIRKVAVIGSGVMGSGIAAHLANVGIPSLLLDIVPNQLTEEEQRKGLTLEDRAVRNRL
ref|YP_148861.1|       VKRIRRAAVLGSGVMGSGIAAHLANVGIPTLLLDIVPRELTKEEEAKGWTLEHKQVRNRL
RAAC01057              MRQIRRAAVIGSGVMGAQIAAHLANVGIPSLLLDLVPQELTAEEQKKGLSLDHPAVRNRL
ref|YP_076839.1|       ---IRKAAVLGAGVMGAQIAAHLANVGIPTLLLDIVPRELTPDEAKKGLTLESPAVRNRL
                             *::.**:*:****: ******:*** ****:**. *. * ** :*:   ****:

ref|ZP_01697463.1|     SQSALQKLLKQKPAPLTSKKSLALIEAGNLEDDLERLKEADWIIEVVTERLDIKKSVFEK
ref|ZP_01173543.1|     SQGALQKLLKQKPAPLTSKKSLALLEAGNFEDDMESLKDVDWIIEVVVENLDIKKQVFAK
ref|NP_244355.1|       ATLALKKLQKQKPAPLSRKSHVHYIQPGNLEDDVEKLAEVDWIIEVVVENLDVKKQLFEK
ref|YP_148861.1|       ANQALERLLKQKPAPLMSKDNIALIETGNFEDDFHRLAEVDWIIEAVVEKLEVKKEVFAR
RAAC01057              ATEAIRRLNKLSPAPLFRADYAKLITPGNLEDDLHRICEVDWVIEVIVESLEPKRQLLER
ref|YP_076839.1|       AASALQNLQKLKPSPLYSKDVLRLITPGNLEDDLAKVAECDWVVEAVIENLQIKKDLWQR
                       :  *:..* * .*:**     .  :.**:***.  : : **::*.: * *: *:.. :

ref|ZP_01697463.1|     VERFRRPGTIVSSNTSGISIEAMAEGRSEDFRKHFLGTHFFNPPRYLKLLEVIPTADTDP
ref|ZP_01173543.1|     VDQFRKPGSIVSSNTSGISVNSMAEGRSDDFQKHFIGTHFFNPPRYLKLLEVIPAKTTAP
ref|NP_244355.1|       VDQYRKQGTLVSSNTSGISISIAAMAEGRSDFQAHFLGTHFFNPPRYLKLLEIIPTKKTKP
ref|YP_148861.1|       VDEVRTPGTIVSSNTSGISISIAAMAEGRSDDFKKHFLGTHFFNPPRYLKLLEIIPTEHTDP
RAAC01057              IERYWHEGMIVSTNTSGISINAMVEGRSEAFRRHFLGTHFFNPPRYMKLLEVIPGRDTDP
ref|YP_076839.1|       VAAHHRPGMICSSNTSGISIQAMVEGTPESFRRHFLGTHFFNPPRYMKLLEIIPTPDTDP
                       :       * : *:******: :*.:* .: *: :******::  * * ref|ZP_01697463.1|     DVTSFMKQFGEDVLGKGVVLAKDTPNFIGNRIGTYGLLVTVREMMKGGYTVGEVDSVTGP
ref|ZP_01173543.1|     EVLSFMKKFGEDVLGKGVVEAKDTPNFIGNRIGTYGLLITVQEMLKGGYSVGEVDSVTGP
ref|NP_244355.1|       EVTAFMKAFAEDVLGKGVVEGKDTPNFIANRIGTYGLLVTVQKMLEGGYSVGEVDSVTGP
ref|YP_148861.1|       DVVAYMKSFGEDVLGKGVVMAKDTPNFIANRIGTYGLLVTVREMMQGGYSVGEVDSVTGP
RAAC01057              AIVEFMRDFGTERLGKGVVLAKDTPNFIANRIGTYGLLVTVEEMQKGGFTVEEVDAITGP
ref|YP_076839.1|       EVVAFMADFGERVLGKGVVMAKDTPNFIGNRIGVYGMMVTLEEMNRLGLTPDEVDALTGK
                        :  :*  *.  ****** .*******.****.**::*:..*  . * :  ***::**

ref|ZP_01697463.1|     VIGRPKSATFRTLDVVGIDTFVHVANNVYEK-TEGEEKEVFKVPAFMHKLVENGWLGSKT
ref|ZP_01173543.1|     LIGRPKSATFRTLDVVGLDTFIHVANNVYEQV-DGKEKEAFEVPAFMKQMLENGWLGSKS
ref|NP_244355.1|       LIGRPKSATFRTLDVVGLDTFLHVAKNV-HDVVDGEEKDVFDPPVFMKKMAENGWIGSKS
ref|YP_148861.1|       LIGRPKSATFRTLDVVGLDTFVHVANNVYENV-EGEEKEAFRVPEFMKTMLENGWLGSKS
RAAC01057              ALGRPKSATFRTLDLVGIDTFVHVANNVRQNVTDPQEQRAFEVPEAIQKLVERGWLGEKS
ref|YP_076839.1|       AIGRPKSATFRTLDVVGIDTFCHVADNCRATIPDPEEEAKIFVVPEPIREMVKRGWVGQKA
                       :************:**:***  ***.*    :  *    * *     :: :.**:*.*:

ref|ZP_01697463.1|     GKGFYEK----KGKEIYELNPETLEYGERTKMKAASLEAARQAKGTANKIKTIVYAD-DR
ref|ZP_01173543.1|     GQGFFKK----EGKEILELNPDTLEYGPRQKLKAASVEMSKQEKGLANKLKALVYAD-DK
ref|NP_244355.1|       GQGFFLKQKGENGSEILELNPSTLEYEKRKKMKAPSIEQAKQAKSLNEKLSILIQAN-DR
ref|YP_148861.1|       GQGFF--VKQG--KDILELNYVTMQYEPRKKLVTPAVEMAKQAKGAAAKLQTLVYADGDR
RAAC01057              GQGFYKRVKQNGQRQILVLDLDTFEYREQKKIASSALEASKQAKGAAGKAKALLQGG-DR
ref|YP_076839.1|       RQGFFKKEGD----QILTLDLETMEYRPRRKASFPSLEAAKANPDLRSRVRGLVFAK-DK
                        :**:          :*: *::*  : *    .::* ::   .  :  ::  .  *:

ref|ZP_01697463.1|     AGRLLWNILAPCLVYSAELSGVIADDILAIDQAMKWGFGWKFGPFETWDAIGVEKSVQKM
ref|ZP_01173543.1|     AGQLLWNILSPALLYSAELLGEIADDVISIDKAMKWGFGWQMGPFETWDSIGLEKSVGKM
ref|NP_244355.1|       AGQLLWNLMKPVLIYSAEKVYEIAGDIKAVDDAMKWGFGWEQGPFEMWDAIGVASSVQRM
ref|YP_148861.1|       AGTLLWNIIAPTLLYTARLVGEIADDIAAIDQAMKWGFGWEQGPFELWDAIGLEKSVRKM
RAAC01057              YAELAWNIVKRVLVYSAEKLGEIADTIQDIDAAMRWGFNWELGPFELWDALGVETAERM
ref|YP_076839.1|       AGEFLWAITKRTLLYAARKVGEIADDVVAIDNAMKWGYNWELGPFEMWDAIGLPESIARM
                          . :*  :    *:*:*.   **.  :  :* **:**:.:  **** **::*  .:  :*
```

FIG. 33B

```
ref|ZP_01697463.1|   EEDGLQVPGWVKGMLEKGFTSFYKEENGVVSYYDNGAYKPLPANPKEINLKALKTQGKVL
ref|ZP_01173543.1|   EAEGKEVPAWIKEMLSNGHTSFYKEENGDISFYKNGEYVPEEENPKNINLKKLKKQKGVI
ref|NP_244355.1|     EEEGATVPSWVKEMLTSGRERFYQ--DG--TFYHHGEAKVIPINGKIIHLKALKPE-RVI
ref|YP_148861.1|     QSEGRDIPSWITDMLADGATSFYKTENGRLFYYAPGGYKTVEENEKVIHIRRLKEARGVI
RAAC01057            RAEGLRLPSWVEDWIAAGHRAFYEEKDGKLTMPVNGKPEPVRVPAGVIDLAALKKAGKVI
ref|YP_076839.1|     EAEGEAVPDWVKE--AARKGGFYRREAGKSFFINKGEYAPVPVSDRVIDIGALRETGRVV
                      .:*   :* *:           **. *       *       *.:  *:    *:

ref|ZP_01697463.1|   KENAGASLIDIGDGVLLLEFHSKSNTIGLDILQMINYAVDEAEKH-YKGIVIGNQGKNFC
ref|ZP_01173543.1|   KKNTGASLLDLGDGVALLEFHSQSNAIGLDIIQMINFAVDEVEKN-YKGLVIGNQGKNFS
ref|NP_244355.1|     TKNSGASLIDLGDDVALLEFHSPNNSIGFDVVQMINKAVDEVEAN-YKGLVIGNQGKNFC
ref|YP_148861.1|     KKNAGASLIDLGDDVALLEFHSPNNAIGADIVQMINEALEEVNRN-YKGLVIGNQGKNFC
RAAC01057            AQNTGASLIDLGDGVACLEFHSQNNAIGPDILTMIEKSVAIAEKD-FAGLVIANQGKNFC
ref|YP_076839.1|     REKKGATLLDMGDGVLLMETHSPKAAIGFDIINMCKVAAEELASGRWKGLVIGARTENFC
                      :: **:*:*:**.*   :* **   .:** *::   * : :   : *:**. : :**.

ref|ZP_01697463.1|   VGANLALMLMEAQDDNIFELDMVVRQFQNTMMKIKYSQKPVVAAPFAMTLGGGAEVCLHT
ref|ZP_01173543.1|   VGANLAMILMEAQDDNVFELDMVVRHFQQAMMKIKYSTKPVVAAPFAMTLGGGAEICLPA
ref|NP_244355.1|     VGANLMMILMEAQDDNFFEIDMVVRQFQQAMAKIRYSQKPVVSAPFAMTLGGGTEICLPT
ref|YP_148861.1|     VGANLAMMLMEAQDENFFELELAVRQFQQALLKMKYNPKPVVVAPFAMTLGGGAEVSLAA
RAAC01057            VGANLMLILMAAQEGDWDEIDLSIRQFHRAMLALRYSQVPVVAAPHRMTLGGGVEVCLAS
ref|YP_076839.1|     VGANVAIMLMEAQEEEWDELEFMAREFQNAFMALKLAPKPVVVAPYGMTLGGGYELCAVA
                     ****: ::** **: :  *:::  *.*:..::   ::     *** **. ****** *:.  :

ref|ZP_01697463.1|   AHIQAASETYMGLVETGVGLLPGGGGNKELYIKHLKNIPEGVQFDLQNVVNKVFETIAMA
ref|ZP_01173543.1|   AHIQASMETYMGLVEAGVGLIPGGGGNKELYIKHLEGMPNGVEFDLQKVANKVFESIAMA
ref|NP_244355.1|     ASIQASLETYMGLVEVGVGVIPGGGGNKELYLRHLERLPEGANIDLQSIANKTFETIAMA
ref|YP_148861.1|     SRIQAAAETYIGLVEVGVGLIPGGGGNKELYIKRLNSLPRGVDVDYVKIAASVFETIAMA
RAAC01057            SRVLPAAETYFGLVEVGVGVIPGGGGCKETARRVAESV--GPEDDLVPALARMFQAIGTA
ref|YP_076839.1|     DRVVAAAESYIGLVEVGVGVIPGAGGNKEMLIRGLEGLPAGAQVDIQPILNRIFETIATA
                       : .:  *:*:**.*::. **    :   : :  * : *      *::*. * ref|ZP_01697463.1|   KVSTSAEEARESGFLDRTDGVSFNQDHLIYDAKQAVLRLADAGY-KPPVREKVPVTGESG
ref|ZP_01173543.1|   KVSTSGEEARENNFLGAADGISVNGDHQLYDAKQAVLALHEQGYT-PPVRKKIPVVGETG
ref|NP_244355.1|     KVSTSAHEAMENGFLSERDGVVVNGDHLLYQAKQQVIHLHDAGY-RPPARKKIPVVGETG
ref|YP_148861.1|     KVSTSAAEARELGFLNHRDGITMNGDHLLYEAKQAVLSMYEEGY-RPPVRKKVPVAGESG
RAAC01057            KVSTSGAEALAMGWLRETDRVVVNDDLRISAAKAEVLRMAEIGYTAPPKAKEIRVAGRDG
ref|YP_076839.1|     KVATSAREAQEMGYLRKSDVIVVNKDHQLYEAKRVVLALEAAGY-RPPEPALIPAAGPEG
                     :.**  .:*   * : .*  :  :   **  *: :        : ..*  * ref|ZP_01697463.1|   YAALLLGAQQMHLSGYISDYDLEIAKKIAFVLSGGKVPFGTKVDEQYLLDLEREAFLSLI
ref|ZP_01173543.1|   YATLLLGAQAMLYSGFISEHDLKIAQKLAYVIAGGKVPYGTEVDEQYLLDLEREAFLSLV
ref|NP_244355.1|     YATMLLGAKSMKFGGMISEHDLKIAEKLAFVIAGGRVAKGTLVDEQYLLDLEREAFLSLV
ref|YP_148861.1|     YAAMLLGAQSMFHSGYISEHDLKIAKKLAYVLAGGKVPYGTEVDEQYLLDLEREAFLSLI
RAAC01057            KATLQMAARSMWNGGYITDYDLHIAYKLAHVLAGGDVPAGSLVSEDYLLDLEREAFLSLC
ref|YP_076839.1|     RAVLELGAYGMFMGGWATEHELFIARKLAYVLTGGNVPAGTLVTEQYLLDLEREAFLSLL
                      *.: ::.*   *  .*   ::::* ** *:*.*::** *. *:  * *:************ ref|ZP_01697463.1|   AQPKTQQRMQHMLLKGKPLRN
ref|ZP_01173543.1|   AQPKSQQRMQHMLVKGKPLRN
ref|NP_244355.1|     GEPKSQQRMQHMLMKGKPLRN
ref|YP_148861.1|     GEPKTQARMQHMLVKGKPLRN
RAAC01057            GEPKTIQRMQHMLATGKPLRN
ref|YP_076839.1|     GTKKTQERMAHLLKTGKPLRN
                      . *: ** *:*  .******
```

FIG. 34

```
ref|NP_691707.1|          ----------------KARAVDGPHQPFHATEIKRRNLDSHDVLIEIKYSGICHSDIHTA
RAAC00352                 MHICFESAEEVEGMQVKARGVLSKESPFHAIKIERRELQPDDVLIEIHYCGICHSDIHSA
ref|YP_829756.1|          --------------------------------IERRDVGPHDVLIGIKFAGICHSDIHTV
ref|YP_947785.1|          --------------------------------IERREVGPNDVHIDIKFAGICHSDIHTV
ref|YP_001221402.1|       ---------------VNAYAATSATDPITKTTIERRDVGPKDVSIDIAYSGVCHSDIHTV
ref|YP_885435.1|          ---------------VSAYAATSATEPLTKTTITRRAVGPHDVAFDIHFAGICHSDIHTV
                                             * **  :  ..**   :  *  :.*:*****:..

ref|NP_691707.1|          HGEWGEVNYPLVPGHEIAGVVSDVGPEVTKYKVGDRVGVGCMVDSCGECENCRRGEEQYC
RAAC00352                 RGEWGEVRYPFVPGHEITGIVSKVGSQVTKFKPGDRVGVGCMVDSCGECENCKRGDEQYC
ref|YP_829756.1|          RGDWGPQQYPLAPGHEIAGIVTDVGSEVTKHAVGDRVGVGCMVNSCRECVNCQKGEEQYC
ref|YP_947785.1|          RGDWGPQQYPLAPGHEIAGIVTEVGSDVTKHKVGDRVGVGCMVNSCKECKNCLAGEEQYC
ref|YP_001221402.1|       RGEWGPIAYPQVVGHEIVGRVTEVGSEVSKHEVGDLVGVGCMVNSCKECEQCKAGGEQYC
ref|YP_885435.1|          KAEWGVPNYPVVPGHEIAGVVTEVGSEVTKYKVGDRVGVGCFVDSCRECDNCKAGLEQYC
                           :.:      . ****.* *:.**..:*:*.   ***:*:   :*   *  **** ref|NP_691707.1|          H-QGNVQTYGGVD-KYGEPTQGGYSTHIVVTEDFVLRIPDNIELDVAAPLLCAGITTYSP
RAAC00352                 V-KGNIQTYGSVD-RYGQYTMGGYSTHIVVKEDFVLRIPDALPLDKAAPLLCAGITTYSP
ref|YP_829756.1|          L-KGNIGTYGAVD-RDGTITQGGYSTHVVVTEDFVVRIPEGIELDVAAPLLCAGITTYSP
ref|YP_947785.1|          L-KGNVGTYGSVD-RDGTITQGGYSSHVVVNEDFVVTIPEGLDLDVAAPLLCAGITTYSP
ref|YP_001221402.1|       L-KGNIQTYGGTDPADGTITQGGYSEAVVVDEDFVLRVPESLDIEKVAPLLCAGITTYSP
ref|YP_885435.1|          TGTGMVGTYNAID-RDGTPTHGGYSGAIVVDENYVLRIPDSLPLDAAAPLLCAGITTYSP
                            : **..  *    *   * ** : *::*: :*:  :  ::  .************ ref|NP_691707.1|          LNHWNAGPGKKVAVVGMGGLGHMAVKIAHAMGAEVTVLSRTLNKKEDGLEFGAENYYATS
RAAC00352                 LRHWQAGPGKEVAVVGLGGLGHMAVKLAKAMGAKVTVLSQSLRKKEDGLRLGAKAYYATS
ref|YP_829756.1|          LHHWGAGPGKKVAVVGLGGLGHMAVKIAHAMGAEVTVLSQSLKKQEDGLKLGADHYYATS
ref|YP_947785.1|          LHHWGAGPGKKVAVVGLGGLGHMAVKIAHAMGAEVTVLSQSLKKMEDGLKLGADHYYATS
ref|YP_001221402.1|       LRHWNAGPGTKVAVVGMGGLGHMAVKIAHAMGAEVTVLSQTLSKKEDGLRLGADRYFATS
ref|YP_885435.1|          LRHWNAGPGKKVAVIGLGGLGHVAVKLAKAMGADVTVLSQSLKKMEDGLRLGASAYYATS
                          *. .:*:*:***.:*:*:**.***::*  * ** .:. *:*** ref|NP_691707.1|          EKETFETLAGSFDLIINTVSAKLDMDAYFSLLNLDGSLVNVGAPAEPLSVNVFSLIGHRR
RAAC00352                 DPETFRQLAGRFDLIINTVSAKIPITEYLGLLKTDGALVNVGAPPEPLEVNAFALIAQRR
ref|YP_829756.1|          DENTFSDLAGSFDLIINTVSASIDISSYLQLLTLDGALVNVGAPAEPLPVNAFALIAGRR
ref|YP_947785.1|          DPATFEQLGGTFDLIVNTVSASIDISAYLQLLTLDGTLVNVGAPAEPLPVNVFSLITGRR
ref|YP_001221402.1|       DDATFTELASSFDLIINTVSAKLDMSKYIGLLAIDGTLVNVGAPSEPLEIPAFALIPARR
ref|YP_885435.1|          DPETFDKLAGSFDLILNTVSANLDLGAYLGLLKLDGALVELGLPEHPMEVPAFPLLAQRR
                           :  **  *..  ****:*****.:  :    *: **  **:**::*  *  .*.*:   **

ref|NP_691707.1|          SFAGSLIGGIRETQEMLDFCAEHNIVPKIEVISADQIDEAYTRVLDSDVKYRFVIDVSTI
RAAC00352                 TFAGSCIGGIRETQEMLDFCAESGVTPEIEVISADEIDAAWERVLKSDVRYRFVIDISTM
ref|YP_829756.1|          SFAGSMIGGIRETQEMLDFCAEHNLGAEIEVIPAEKINEAYERVLASDVRYRFVIDTATL
ref|YP_947785.1|          RFAGSAIGGIRETQEMLNFCAEHGLGAEIEVIPASKINDAYERVLASDVRYRFVIDVSTI
ref|YP_001221402.1|       SWAGSMIGGIAETQEMLDFCAEHGIVPETELISAEQINEAYERVLKSDVRYRFVIDAKT-
ref|YP_885435.1|          NLTGSMIGGIPETQEMLDFCAEHDVRPEIEIITPDYINEAYERVLASDVRYRFVIDTASL
                            :** **** ******:****  .:  .:  *:*...   *: *:  *** ***:******   :

ref|NP_691707.1|          --
RAAC00352                 RN
ref|YP_829756.1|          --
ref|YP_947785.1|          --
ref|YP_001221402.1|       --
ref|YP_885435.1|          RS
```

FIG. 35

```
ref|YP_055250.1|        --------MKAALVEQYHEPLAIRDIPEPAHDSDGVVVEVKACGVCRSDWHGWQGEWPGF
ref|YP_134751.1|        --------MRAAVLEEYEEPLAIRDVERPDPDPDGVVAKVDACGVCRSDWHGWVGNWDWF
gb|ABW71834.1|          --------VRAAQIVGYGEPLQVREVPDPAPEPGGVVVAVLATGICRSDWHGWRGDWEWL
RAAC04321               MERERGQAVKAARMVGFREPLVIERVPDPTPGPEDAVIRVEASGICRSDWHGWMGDWTWL
ref|YP_612035.1|        --------MKAVLYETFKELPKLVTVEDPTPDPDGVVIKVEATGLCRSDWHGWMGHDSDI
ref|ZP_01441442.1|      --------MKAVLFETFQEAPKLVTVPDPVPDAHGVVLKVAATGVCRSDWHGWMGHDSDI
                                ::*.    :  *    :  :    . ...*   * * *:******** *.  :

ref|YP_055250.1|        -TGGSLPHIFGHEFVGLVSDIGNNVSRYRVGDRVIVPFTLGCGHCEYCRSGHSNVCP-TV
ref|YP_134751.1|        DYKPPRGHILGHEPSGTVVEVGENVDTVKEGDTVAIPFNFACGHCHECRVGYENLCENHL
gb|ABW71834.1|          GGRIALPRTPGHEIAGEVVAAGPGVRGVRVGDRVTVPFHLACGTCAHCRAGQANLCD-EM
RAAC04321               GLSPQLPITPGHEFGGEIVALGREVRDFQIGDKVTVPFHYACGHCEHCHAGVPNRCD-HV
ref|YP_612035.1|        ----VLPHVPGHEFAGVIVALGKNVRNWTVGDRVTVPFISGCGHCSECHAGHQQVCH-NQ
ref|ZP_01441442.1|      ----ELPHVPGHELAGEVAAVGKDVRNWKIGDKVTVPFICGCGHCSECHAGQQQVCL-HQ
                                ***  *  :    *   *  **   * :  .  *  *:  *  : * ref|YP_055250.1|        SMPGFSY--DGGFAQYVTVPDADANLVKLPDAVDFTDAAGMGCRLMTAYHGIVEVGQIHP
ref|YP_134751.1|        GL-GFQPGAPGAFAEEVPIPNADINAVKLPDGVDPVEVAGMGCRFMTSYRGMAHQADVSR
gb|ABW71834.1|          EVLGFWR--DGGYAEYVRIPHADFNCVRIPDGVTPLTASAIGCRFMTAFHAVDGQGRVRP
RAAC04321               GIYGFSW--DGSFAEYVVVRNANMNLIRLPEGVDALTAAAVGCRFMTGYHGVMRGG-VRP
ref|YP_612035.1|        QQPGFTH--WGSFAEYVGVRQADLNLVALPQEMDFATAASLGCRFATSFRAVVDQAQTRA
ref|ZP_01441442.1|      EQPGFTH--WGSFAEYVPIHQADLNLVALPEGMGFDTAASLGCRFATSFRAVIDQGKVRA
                           **       *.:*: *  : .*: * :  :*: :      .:.:***: *.::.:    .

ref|YP_055250.1|        GDWLVVYGAGGVGLSATLVATSAGANVIAVDIADDKLALARKVGAIATINSRE-TDPVEA
ref|YP_134751.1|        GEYVVVQGLGGIGLSAVHIADALGGNVIGVDLMDEKLEMAEELGAIDTVNAAEEDDVVQA
gb|ABW71834.1|          GEWVAVHGVGGVGLSCVQIASAAGASVVAVDIDPAKLALAEQQGAAHTVDAGAEQDVPAA
RAAC04321               GQWVAVHGAGGVGLSAIQTAYAVGARVIAVDVDDEKLAKAREEGACEVVNA-KNQPVVEA
ref|YP_612035.1|        GQWVAVHGCGGVGLSAVMIAQAVGANVIAIDIDDEKLNLAQELGAVATINGARVADVPEA
ref|ZP_01441442.1|      GQWVAVHGCGGVGLSAVMIAAAAGANVIGVDLDPVKLALAKEIGAVAAIDG-HEADVPGA
                        *:::.* * :*.     * : *. *:..*:    ** *.: **  .::.       * ref|YP_055250.1|        VRELTDGGADKSVDALGISETLHNAVNSLRSRGTHIQIGMTAE-GPVGDVALTINDLIAK
ref|YP_134751.1|        VRDITDGGAHVSLDALGIEETCQNAIESLRTRGRHVQIGLTTK-EQRGYNSLPTDTIVMN
gb|ABW71834.1|          VREVTGGGAHVSIDALGIRTTVVNSVRSLRKRGRHVQVGLTGA-EDAGEIALPIDLITLG
RAAC04321               IREITKGGAHVSIDALGIRDTVLNSVLSLRKGGRHVQIGLTTS-QEGGFVPLPMDLITSC
ref|YP_612035.1|        VIDLSRGGAHVSLDALGHPLTCFNSIQNLRPRGKHVQVGLMLA-EHST-PSVPMAKVIAK
ref|ZP_01441442.1|      IREITRGGAHVSLDALGHPVTMTNSILCLRPRGKHVQVGLMLG-EHAA-PQVPMPKIVGQ
                        :  ::: ***. *:****     *   *::   **   * *:*:*:           :.   :

ref|YP_055250.1|        EIDFRGSFGMPAVEFRYLLNQVAAGKMKPGQLVTKTIALSEVNDALTAMSTYNTVGTTVI
ref|YP_134751.1|        EIQVQGSSGLPPSKYGEMFRMVENGKLDPGAVITDKIGLEGVSDELAAMTDYETIGIPVV
gb|ABW71834.1|          ELTVVGSHGNPHAAYPRLLSLIESGRLAPQTLVQRTVSLDQAGDVLAAMDAFATSGLTVI
RAAC04321               EIEVVGSLGIPHPDYAGLLALVAEGRLRPRNLVEREVRLEDVNEVFDKMTRFETRGFNMI
ref|YP_612035.1|        ELEILGSHGMQAHRYDAMLDMIASGKLDPRRLVGREISLDAAPSALVKMDQFQSIGATVI
ref|ZP_01441442.1|      EIEILGSHGMQAHRYGAMLDMVASGKLDPARLVGERISLAEAPAALMAMDSFRSVGATVI
                        *:  .  **  *    :   ::    :    *:: *   ::   : *  .   *  :: *  ::

ref|YP_055250.1|        TDF
ref|YP_134751.1|        NEF
gb|ABW71834.1|          DRF
RAAC04321               TAF
ref|YP_612035.1|        TTF
ref|ZP_01441442.1|      TRF
                         *
```

FIG. 36

```
ref|YP_917551.1|              ---------VKICGLTEAAGLAAAVDAGARYVGFVFFPKSPRHVTPGTAAEL---AAQVP
ref|ZP_00631342.1|            ---------VKICGLTEAAGLAAAVDAGARYVGFVFFPKSPRHVTPGTAAEL---AAQVP
ref|ZP_00998521.1|            ---------VKICGLSRPEDVAAAARAGAVYGGFVFFPKSPRHVSVESAREL---AIAAP
ref|YP_001259911.1|           MRRKPMALDIKICGLKTPEAVAAALDGGATHIGFIFFPKSPRHITPDAAARL---RAAAT
ref|NP_105797.1|              ---------IKICGLKTDQAMAAALGGGASHVGFIFFAKSPRYVEPAEAGRLR--EAA--
RAAC04349                     ---MRSLPLLKICGLRPGDDLSFLRHPAVTHVGVVMVPASRRYVSPDEAGDLVRTAKRLR
                                       :*****          ::       ..:  *.::.. * *::    * * ref|YP_917551.1|              ---LGVAKVGLFVNPDDAALDAVLAHVPLDVIQLHGAETPARVAEVKARTGLPVMKAVGV
ref|ZP_00631342.1|            ---LGVAKVGLFVNPDDAALDAVLAHVPLDVIQLHGAETPARVAEVKARTGLPVMKAVGV
ref|ZP_00998521.1|            ---PGLAKVALIVDADDDLIDRITATVPLDMLQLHGTESPDRVAEVRARTGLPVMKAVGL
ref|YP_001259911.1|           G-R--AVTVAVTVDADDEALDEIVKTVRPDMLQLHGGETPERVRFLKERYNLPVMKAFSI
ref|NP_105797.1|              --RGKAVAVAVTVDATDAFLDEIVSAMQPDMLQLHGSEHPERVAELKARYGLPVMKALPL
RAAC04349                     ---PDVTTVAVVSGGSREEIGEGARRAGVDVVQLHGGE-PRDVAERLREAGFRVWRAVAF
                                  . *.:  .       :.       *::**** *  *    . .: * :*.. .

ref|YP_917551.1|              ADPQD-----LDALWD----YGLVADMLLIDAKPPKDAV--LPGGNGLAFDW-RLLA---
ref|ZP_00631342.1|            ADPQD-----LDALWD----YGLVADMLLIDAKPPKDAV--LPGGNGLAFDW-RLLA---
ref|ZP_00998521.1|            SEAAD-----LAA----IDLYSEVADQLLIDAKPPKEAS--IPGGNGLAFDW-RLLQQ--
ref|YP_001259911.1|           REAGD-----LEAIAP----YRGIADRFLFDAKPPKGSE--LPGGNGISFDW-NLLA--A
ref|NP_105797.1|              SEAAD-----LDRIRP----FIGIADRFLFDAKPPKGSE--LPGGNGVAFDW-RILA--G
RAAC04349                     DPGDD-VTSFLDTLRS----HASSADAILFDAKPPSDAKPGVTGGHGRAFDWDRLAEM--
                                *     *        .   **  :*:*****. :    :.**:* :*** .:

ref|YP_917551.1|              --GRQILKPWLLAGGLTPENVHEAIRLTRAPGVDVSSGVESAPGVKDPDRIRSFI-----
ref|ZP_00631342.1|            --GRQILKPWLLAGGLTPENVHEAIRLTRAPGVDVSSGVESAPGVKDPDRIRSFI-----
ref|ZP_00998521.1|            --RKYWSRPWMLAGGLTPDNVAEAIRLTGARQVDVSSGVEAGRGIKDPERIAGFVAA---
ref|YP_001259911.1|           L-DADI--DYMLSGGLNADNIAEALLKTGAPGIDISSGVECAPGEKDVRLIENFFQAV--
ref|NP_105797.1|              L-DAGV--DYMLSGGLNAANIGDALRLANPPGIDISSGVESAPGVKDPALIEQFFRAVRA
RAAC04349                     --ARAFSFDWWVAGGITPENVRDLLRRVRPVGIDVSSGVEVG-GRKDVRRIDQLIQAMEA
                              :  ::**:.. *:  :     .. .  :*:***** . * **  *  :.

ref|YP_917551.1|              ---------
ref|ZP_00631342.1|            ---------
ref|ZP_00998521.1|            ---------
ref|YP_001259911.1|           ---------
ref|NP_105797.1|              ---------
RAAC04349                     WGHESLSLS
```

FIG. 37A

```
emb|CAD30313.1|         -----IAAPKLKEKVEKFLSGKKKMYINGSFVESASGKTFDTPNPATGERLATVYEGDAE
ref|ZP_01697379.1|      --------------VQHFLQGKKKMFINGQFVESASGKTFDTPNPATGETLATIYEGDKQ
ref|NP_833288.1|        ----------LHEKVEKFLQGTKKLYVNGSFIESASGKTFKTPNPATGETLAVVSEAGRE
ref|NP_979866.1|        ----------LHEKVEKFLQGTKKLYVNGSFIESASGKTFNTPNPATGETLAVVSEAGRE
ref|YP_001375474.1|     ----------LHEKVEQFLQGTKKLYVNGTFVESVSGKTFKTPNPATGETLAIVSEAGRE
RAAC01327               MAVQEVNASALHPDVVEFLKGPKGLFIDGEFVPSLSGKTFKSINPATEEVLVEVAEAEAP
                               *  .**.*  *  :::::* *: * ***** .:  **** * *. : *.

emb|CAD30313.1|         DIDRAVKAAREAFDRGPWSRMSAAERSRLMYKLADLMEENKEELAQLETLDNGKPIRETI
ref|ZP_01697379.1|      DIDRAVQAARKAFDEGPWPRMNPADRSRLMYKLADLMEEHREALAQLETLDNGKPIRETA
ref|NP_833288.1|        DIHKAVVAARMAFDEGPWSRMSTAERSRLMYKLADLMEEHKEELAQLETLDNGKPIRETM
ref|NP_979866.1|        DIHKAVVAARMAFDEGPWSRMSTAERSRLMYKLADLMEEHKEELAQLETLDNGKPIRETM
ref|YP_001375474.1|     DIHKAVMAARQAFDEGPWSCMSGAERSRLMYKLADLMEEHKNELAQLETLDNGKPIRETL
RAAC01327               DIDRAVKAARRAFESGPWSRMSAAERSRLLYRLADLMEEHKLQLAQLETLDNGKPIRESL
                        ** :** *** **: *** .* .::*** *;*:*******:: **************:

emb|CAD30313.1|         NADVPLAIEHMRYYAGWSTKIVGQTIPVNGPYFNYTRHEPVGVVGQIIPWNFPLLMAMWK
ref|ZP_01697379.1|      NADIPLAIEHMRYYAGWTTKITGQTIPVNGPYFNYTRHEPVGVVGQIIPWNFPLLMAMWK
ref|NP_833288.1|        AADIPLAIEHMRYYAGWATKIVGQTIPVSGDYFNYTRHEAVGVVGQIIPWNFPLLMAMWK
ref|NP_979866.1|        AADIPLAIEHMRYYAGWATKIVGQTIPVSGDYFNYTRHEAVGVVGQIIPWNFPLLMAMWK
ref|YP_001375474.1|     AADIPLAIEHMRYYAGWATKIVGQTIPVSGDYFNYTRHEAVGVVGQIIPWNFPLLMAMWK
RAAC01327               NADLPLAIEHIRYYAGWPTKVVGQTIPVAGKYFNYTRHEPVGVVGQIIPWNFPLLMACWK
                         :** **  :.**** .. **.****.***** emb|CAD30313.1|         LGAALATGCTVVLKPAEQTPLSALYLAELIEEAGFPAGVVNIVPGFGETAGDALVKHPQV
ref|ZP_01697379.1|      MGAALATGCTIILKPAEQTPLSALYLAQLVSEAGFPDGVVNIVPGFGETAGAALVDHPLV
ref|NP_833288.1|        MGAALATGCTIVLKPAEQTPLSALYLAELIEEAGFPKGVINIVPGFGESAGQALVNHPLV
ref|NP_979866.1|        MGAALATGCTIVLKPAEQTPLSALYLAELIEEAGFPKGVINIVPGFGESAGQALVNHPLV
ref|YP_001375474.1|     MGAALATGCTIVLKPAEQTPLSALYLAELFEEAGFPKGVVNIVPGFGEIAGQALVNHPFV
RAAC01327               IGAALAMGCTVVLKPAEQTPLSALYLAKLIQEAGFPPGVVNVVPGFGETAGQALVEHPDV
                         :*** *::**********:*  * .  *** :* :**** * ** * emb|CAD30313.1|         DKIAFTGSTEVGKLIMANASKSLKRVTLELGGKSPNIILPDADFSKAIPGALNGVMFNQG
ref|ZP_01697379.1|      DKIAFTGSTEVGKLIMANASKTLKRVTLELGGKSPNIILPDADLSKAIPGALNGVMFNQG
ref|NP_833288.1|        DKIAFTGSTPVGKQIMRQASETLKRVTLELGGKSPNIILPDADLSRAIPGALSGVMFNQG
ref|NP_979866.1|        DKIAFTGSTPVGKQIMRQASETLKRVTLELGGKSPNIILPDADLSRAIPGALSGVMFNQG
ref|YP_001375474.1|     DKIAFTGSTPVGKQIMRQASETLKRVTLELGGKSPNIILPDADLSRAIPAALSGVMFNQG
RAAC01327               NKIAFTGSTEVGKLIMRNAAATLKRVTLELGGKSPNIILPDADMSRAIPGAFMGIMFNQG
                        :****** * **: *:.:********************:*.***.*: *:**** emb|CAD30313.1|         QVCCAGSRVFIQKKQYDNVVADMVSHAKSIKQGFGLKADTEMGPLVSSEQQNRVLGYIEK
ref|ZP_01697379.1|      QVCCAGSRVFIQKKHFDNVIADMASHAQSIKQGFGLNKDTEMGPLVSDEQQARVLNYIEK
ref|NP_833288.1|        QVCSAGSRLFVPKKMYDNVMADLVLYSKKLNQGVGLNPETTIGPLVSEEQQKRVMGYIEK
ref|NP_979866.1|        QVCSAGSRLFVPKKMYDNVMADLVLYSKKLNQGAGLSPETTIGPLVSEEQQKRVMGYIEK
ref|YP_001375474.1|     QVCCAGSRLFIPKKMYDNVMADLVLYSKNLTQGAGLDPKTTIGPLVSEEQQQRVMGYIEK
RAAC01327               QVCCAGSRLFVQKKAYDNVVADLVSLAKKIRQGPGLDQGTEMGPLVSDEQEKRVLGYIEK
                        *.**:*:   *:**:*  ::. :: . .  *.***.: **** emb|CAD30313.1|         GLEEGAELLTGGQKPSEQGYFVEPTIFANVEDSMTISKEEIFGPVIAALPYEDIDELIER
ref|ZP_01697379.1|      GLDEGAEIVTGGKKPREEGFFVEPTIFADVRDEMTIAKEEIFGPVIAAMPYESLDEVISR
ref|NP_833288.1|        GIEEGAEVLCGGSNPFDQGYFVSPTVFADVNDEMTIAKEEIFGPVISAIPFNDIDEVIER
ref|NP_979866.1|        GIEEGAEVLCGGSNPFDRGYFVSPTVFADVNDEMTIAKEEIFGPVISAIPFNDIDEVIER
ref|YP_001375474.1|     GIEEGAEVLCGGNKPFDKGYFVAPTVFADVNDEMTIAKEEIFGPVISALPFNDIDEVIER
RAAC01327               GVEEGAEVLVGGGKATDRGYFVQPTIFANVRDDMTIAREEIFGPVVAAMPFEDLDEVIAR
                        *:::****:: ** :.  :.*:** **:** * :*** *********::*::::**:* *
```

FIG. 37B

```
emb|CAD30313.1|        ANDTNYGLAAGVWTRDVTKAHYIANKLRAGTVWVNCYNVFDAASPFGGYKESGIGREMGS
ref|ZP_01697379.1|     ANCSEYGLAAGVWTENVANAHYIANRLRAGTVWVNCYNVFDAASPFGGYKQSGIGREMGS
ref|NP_833288.1|       ANKSQFGLAAGVWTENVKTAHYVASKVRAGTVWVNCYNVFDAASPFGGFKQSGLGREMGS
ref|NP_979866.1|       ANKSQFGLAAGVWTENVKTAHYVASKVRAGTVWVNCYNVFDAASPFGGFKQSGLGREMGS
ref|YP_001375474.1|    ANKSSFGLAAGVWTENIKNAHYIASKVRAGTVWVNCYNVFDAASPFGGYKQSGLGREMGS
RAAC01327              ANDTEYGLAAGVWTENIRNAHYIASKLKAGTVWVNCYNVFDAAAPFGGYKQSGIGREMGS
                         :.:****.::  .*:*.:::**************:**:*::**** emb|CAD30313.1|        YALDNYTEVKSVWIA--
ref|ZP_01697379.1|     YALQNYTEVKSVWIA--
ref|NP_833288.1|       YALNNYTEVKSVWLNLN
ref|NP_979866.1|       YALNNYTEVKSVWLNLN
ref|YP_001375474.1|    YALDNYTEVKSVWVNLN
RAAC01327              YALNNYTEVKDVWISLS
                       ***:******.**:
```

FIG. 38A

```
ref|YP_001125497.1|    ----PACATASLGNYRFADLPDPSKWADCVHCGMCLESCPTYEQTGEEQHSPRGRVHLMK
ref|YP_147384.1|       ------------------------------------------------------------
ref|YP_175672.1|       ---DPPCSPTSKSNYLWNDAPDENKWADCVHCGMCLESCPTYEITGQEQHSPRGRVHLIK
ref|NP_243001.1|       -----------TNYHWSDHPDPNKWADCVHCGMCLEACPTYELTGHEQQSPRGRVHLIK
RAAC01351              MVNEPTAVAAKGSDFRFPDAPEEEKYSVCVHCGFCLEVCPTYQAWGDENHSPRGRVYLIK
ref|YP_001108459.1|    --------------------PQRELIDDCVHCGFCLPSCPTYELWGEEMDSPRGRIYLMK ref|YP_001125497.1|    SVGEGKLDLTPDLLDPIFTCLDCRACTTACPADVDVGGLIEQVRGQLRQAVPLTGWKALV
ref|YP_147384.1|       ------------LLDPIFTCLDCRACTTACPADVDVGGLIEQVRGQLRQAVPLTGWKALV
ref|YP_175672.1|       SVAEGKLEVNEPFIDPVYQCLDCRACTTACPADVDVGGLIEEARGQIRQAMPLTGIKGLV
ref|NP_243001.1|       SVAEGKLEVNEAFADPVFTCLDCRACETACPADVEVGGLIEEARGQIRQALPLSGWKKVV
RAAC01351              ACAEGELPLDESVIDPVFTCLDCRACETVCPSGVQVGALVEEARGQVFYARDAEGKRDPV
ref|YP_001108459.1|    EGLEGE-PMTGSMVGHFDACLGCMACVTACPSGVQYGTLITETRAQV-ERRHERGRWEKL
                              ..  **.* ** *.**:.*: * *: :.*.*:      *    :

ref|YP_001125497.1|    NDFFLKGIFPHPSRLDWLGRLLKLYQQSGLQTVARKTGMLRVMPDHLAEMEAILPKVGTP
ref|YP_147384.1|       SDVFLKGIFPHPSRLDWLGRLLKWYQKSGLQTVARKTGLLRVMPDHLAEMEAILPAVGTP
ref|YP_175672.1|       SKFFLEGLFPHPKRMQSLGGLLKIYQKSGVQKLVRTTRLIRIMPKHLVELEAIMPGMGVP
ref|NP_243001.1|       SHLFLRGLFPYPHRLHALGSLVKVYQKVGIRKAVRKTGLLHLFPEHFADMEAVIPEVSTP
RAAC01351              MRFFLRGVFPRPARLRIIRRLMRFYQKSGLQKLARSTGVLRVLPPQVREMEDVIPEIGRG
ref|YP_001108459.1|    LRAGIFALFPYPRRLRAMRGPLALYQKTGLSKLVKRSGLLRKMPASLRVMESLAPPISRA
                          : .:** * *:    :    **: *:. . .:  :::  :*   . :* . * :.

ref|YP_001125497.1|    VRKKYRNEPLIKAKGETKRTVAILTGCIMDVMFSDINEATIRVLTRNGNDVVIVSDQTCC
ref|YP_147384.1|       VRRKYKHQPLIKAKGETKRTVAILTGCVMDVMFSDINEATIRVLTHNGNDVVIVPNQTCC
ref|YP_175672.1|       VRKKYKNENIILAKGEETHTVAFLTGCIMDVMFSDINESTIQVLTRNGNNVTIPKQQTCC
ref|NP_243001.1|       VQKRYRKKSFIKAKGKSKQRVTLLAGCVMDVMFSEVNEATIRVLTRNGNDVSLPKDQTCC
RAAC01351              PAIDVLPET-IAPQGERKATAALFTGCVMDVFFSDVNEATARVLVRNGVEVRVPKDQICC
ref|YP_001108459.1|    PK----LGNRVPARGTRRATVGMITGCVQSAFFPDVNAATARVLSAEGCDVVIPRAQGCC
                          ..:*     . :::**:  ...*.::* :*  :**  :* :*  :   * ** ref|YP_001125497.1|    GALHVHAGDRETGRKLAKQNIEAFQ--GVDHVIVNAAGCGAMLKEYPELFRH-DPEWHEK
ref|YP_147384.1|       GALHVHAGDRETGRKLAKQNIEAFQHV--DHVIVNAAGCGCMLKEYPELFRH-DPEWHEK
ref|YP_175672.1|       GALHVHAGDRETGRRLAKQNIEAFENAQT--VIVNAAGCGCMLKDYPELFRD-DPKWHEK
ref|NP_243001.1|       GALHVHAGDREMGRRLAKQNMKAFE--NEETIIVNAAGCGSMLQEYPELFREVEREWYER
RAAC01351              GALQVHAGDRDMAREMAKRNIEVFERAGADYVAINAAGCGAALKEYPELFRD-DPAWRDR
ref|YP_001108459.1|    GALSEHTGREEEAVRFARNLLDTFEDAGVEYVVINSAGCGSTLKEYPRLLRD-DPEYAEK
                       ***   *:*   .: . ..:*:. :...*:     : :*:****. *::**.*:*.  :   : ::

ref|YP_001125497.1|    AEQFAAKVEDVSKFLYDTGFKAPKAELNVRLTYHDACHLAHGQGIRKEPRAVIESIPGVE
ref|YP_147384.1|       AEQFAAKVEDVSKFLHDTGFKPPKAELNVRLTYHDACHLAHGQGIRQEPRALIESIPGVE
ref|YP_175672.1|       AKAFSAKVQDITKYLYDTGYEKPKSEMKIRLTYHDACHLAHGQGIRQEPRELLHAIPGVE
ref|NP_243001.1|       AEAFAEKVKDVSKHLYDTGYEKPKGEVRAKVAYHDACHLAHGQNVRQEPRDLLLKISGVE
RAAC01351              AVQFSSRVRDISQLLVEVGFDPPKAELPMAVTYHDACHLFHAQKIRYEPRSLLKSVPGLT
ref|YP_001108459.1|    AERFSARVRDIAELLVELGPVAERHPLPVRAAYHDACHLAHGQGIRSQPRELLRGIPGME
                       *  *: :*.*::: * : *  :    :     :*******.*.*  :* :: ::.*:

ref|YP_001125497.1|    MVAMPNADRCCGSAGIYNLTHPDMAQAVLESKMQNVPQD-VELISMGNPGCMLQMALGVM
ref|YP_147384.1|       MVAMPNADRCCGSAGIYNLTHPEMAQAVLESKMQHVPQE-VELISMGNPGCMLQMALGVM
ref|YP_175672.1|       IVHMPNADRCCGSAGIYNITNPEMAGAVLESKMENVPED-VEMISMGNPGCMLQMAVGVQ
ref|NP_243001.1|       LIPMENADRCCGSAGIYNLTHPKMASRVLEKKMECVPSD-VEMVSMGNPGCMLQMAMGVK
RAAC01351              LCEMPDSDRCCGSAGIYNLTHPAMANELLERKMDDVPEG-VDAIVMGNPGCMMQIRLGVK
ref|YP_001108459.1|    VREINRGELCCGSAGVYNILQPEAAMDLGDRKAENVLDTGAELLISANPGCAMQIRTSLE
                         :   .:  ******:**: :*   *  : *  :   : *   .****  *:   .:
```

FIG. 38B

```
ref|YP_001125497.1|     KHGRNQKIVHTVQLLDWAYQKE---
ref|YP_147384.1|        KHGRNQKIVHTVQLLDWAYQKE---
ref|YP_175672.1|        KYGRRQKIVHTVQLLNWAYKRD---
ref|NP_243001.1|        KYGGNQRIIHTVQLLDLAYQQE---
RAAC01351               RRNQPLRVMHTVEVLDLAYRREGSR
ref|YP_001108459.1|     RRGSELAMAHTVEVLDASIRGLGA-
                         : .    : ***::*:  :   :
```

FIG. 39A

```
ref|YP_147385.1|        ----------------------------------IATNDPHIQALARIV-GEQAILYRKED
ref|YP_001125498.1|     ----------------------------------IATNDPHIRALARIV-GEEAILYRKED
ref|YP_175671.1|        ----------------------------------IKTNDPDILNLAKLVDGPKSILYLKED
RAAC01352               MHDADPARRQAQEPAIARHAHGRSARSRLPEGGIAMRDVHIDRLVEIV-GERRCLWRPHQ
ref|NP_926015.1|        ----------------------------------------QMEQIV-GKSGVVWTPEE
ref|YP_001660274.1|     ----------------------------------------IKQLEAIL-GKDGVIRRKDE
                                                                    :  ::  *     :    .:

ref|YP_147385.1|        LMAYDCDGFTVHRHLPRAVVFPNSTEQVAAVVKYCHEHDLPFLARGAGTGLSGGAIPLNG
ref|YP_001125498.1|     LIAYDCDGFTVHRHLPKAVVFPNSTEEVAAVVKYCHEHELPFLARGAGTGLSGGAIPLNG
ref|YP_175671.1|        LIAYDCDGFTIHKHLPKAVVFPKNTEEVAKIVNYCASHDLPFLARGAGTGLSGGAIPING
RAAC01352               VKAYACDGYTAEEGLPRAVVFPESTDEVARICRYLYENDIPYLPRGAGTGLSGGATPTGG
ref|NP_926015.1|        LLVFECDGLTSYKQRPALAVLPRTTEEVSRVLALCYREGLPFVARGSGTGLSGGALPVEG
ref|YP_001660274.1|     LLTYECDGITGYRQRPALVVLPRSTAEIAAVVKLCHDNEIAWVARGAGTGLSGGALPLEE
                        :  .:  ***  *     . *  .*:*..*  :::  :        .   :.::.:******  * ref|YP_147385.1|        EVVISLTRMKRLLHVDLENRRAVVEPGFVNLKLTNSVAHRGYYYAPDPSSQYCCTIGGNV
ref|YP_001125498.1|     EVIISLTRMKRLLHVDLENRRAVVEPGFVNLKLTNSVAHRGYYYAPDPSSQYCCTIGGNV
ref|YP_175671.1|        EVIISMVRMKRLISVDLENRRAVVEPGYVNLKLTNMIADKGYYYAPDPSSQSCCTIGGNV
RAAC01352               EVVISLARMNKLLAVDFDNLRAVVQPGLVNLTLTRRVSHADCYYAPDPSSQSVCTIGGNF
ref|NP_926015.1|        CVLVVTARMNRILAVDLDNRQVVVQPGVINNWVTQAVSGAGFYYAPDPSSQSICSIGGNV
ref|YP_001660274.1|     GILIVTARMNQILRVDLDNQRVVVQPGVINNWVTQAVSGAGFYYAPDPSSQIICSIGGNV
                         ::    .**:::: **:: *  :.**: * :*   :*.  ::   .  *********  *:****.

ref|YP_147385.1|        AENAGGAHCLKYGVTTNHILGLEVVLPNGEVIEIGGNGVPDPPGYDLLGLLTGSEGTLGI
ref|YP_001125498.1|     AENAGGAHCLKYGVTTNHILGLEVVLPDGEVIEIGGNGVPDPPGYDLLGLLTGSEGTLGI
ref|YP_175671.1|        AENAGGAHCLKYGVTTNHILGLEVVLPNGDIIDINCEGIADVPGYDLLGLLTGSEGTLGI
RAAC01352               AENAGGSHCLKYGVTTNHVVAAKVVLPDGDVIDVGAP-FGDAPGYDLLGLLVGSEGTLGI
ref|NP_926015.1|        AENSGGVHCLKYGVTTNHVLGLKLVLPDGEVVDVGGR-VPETPGYDLAGVFVGSEGTLGI
ref|YP_001660274.1|     AENSGGVHCLKYGVTTNHVMGLKIVLPDGSIIDVGGA-VPEQPGYDLTGLFVGSEGTLGI
                        *:  *********::.   :::*.::::.       .  :   ***** *::.******** ref|YP_147385.1|        VTKITVRLLKNPEAKQTVLAYFDEVEDASQTVSDIISAGIVPAALEMMDQTAIEAVEAAA
ref|YP_001125498.1|     VTKITVRLLKNPEAKQTVLAYFDEVEDASQTVSDIISAGIVPAALEMMDQTAIEAVEAAA
ref|YP_175671.1|        VTKITVRILKNPEAKQTVLAYFDEVSDGSYAVSDIVSAGIVPAALEMMDKTAIEGVEAAA
RAAC01352               ATEITVRILKKPQALRTALAYFDRVADASDTVTDIIGAGIIPAAIEMMDQLAMQAVDKSN
ref|NP_926015.1|        ATEITLRLLKSAESIRVLLADFAAIEEAGAAVTAIIAAGIVPGGMEIMDNLSINAVEDVV
ref|YP_001660274.1|     ATEITLRILKTPESICVLLADFTSIEAAGQAVADIIKSGMIPAGMEIMDNLSINAVEDVV
                        .*:**:*:**...::    .  ** *    :   .. :*:  *:   :*:::*.**:  :::.*:

ref|YP_147385.1|        FPVGHPKDIAALLLIEVDGISAGIDEQINDILTICRRHHVREVKVAQSEEERARWWANRK
ref|YP_001125498.1|     FPVGHPKDIAALLLIEVDGISAGISEQIDDILTICRRHHVREVKVAESEEERARWWANRK
ref|YP_175671.1|        FPVGHPRDIAALLLIEVDGISAGIDEQINQILDICKRRHVREVKVAENEQERARWWANRK
RAAC01352               YHVGYPTDIEAVLLIEVDGLAAGVDEVMARVVEICRRHRVREVRVAQSDAERALWWSSRK
ref|NP_926015.1|        ATDCYPRDAGAILLVEVDGLAVEVEAASARVEALCLEAGARAVRTATDPAERLKLWKGRK
ref|YP_001660274.1|     ATGCYPRDAESVLLVELDGLGVEVTRNKHRVAEICRQNGARNITTANDAETRLKLWKGRK
                              :* *  ::**:*:**:..  :        :  :*. .* :.* .   *     * :**

ref|YP_147385.1|        TGFGAMGAISPDYLVQDGVIPRSRLPEVLREIADISRKYGLRIANIFHAGDGNLHPLVLF
ref|YP_001125498.1|     TGFGAMGAISPDYLVQDGVIPRSRLPEVLREIANISRKYGLRIANIFHAGDGNLHPLVLF
ref|YP_175671.1|        TGFGAMGAISADYLVQDGVIPRSKLPEVLERINQISEQFGLRIANIFHAGDGNLHPLVLF
RAAC01352               MAFGAMGRISPDYIVQDGVIPRTRLTEVLQKIDEVSRRYGLKIANVFHAGDGNLHPLILY
ref|NP_926015.1|        AAFAAMGQRAPNYYVQDGVIPRTKLQFVLQQIELLSEKHGYPVANVFHAGDGNLHPLILY
ref|YP_001660274.1|     AAFAAAGKISPNYFVQDGVIPRTQLVYVLQEIKALSEKYGYKIANVFHAGDGNLHPLILY
                         .*.*  *   ::.: ********:*    **..*    :*.:.*   :**:************.*:
```

FIG. 39B

```
ref|YP_147385.1|       DASKPGETERALAAGSECLKACAAVGGSITGEHGVGIEKKEEMRFIFTDEEILAQTAIRD
ref|YP_001125498.1|    DASQPGETERALAAGSECLKACAAVGGSITGEHGVGLEKKEEMRFIFSDEEILAQTAIRD
ref|YP_175671.1|       DARIPGETEKALEAGSACLKACADVGGSITGEHGVGIEKMEEMRFVFNEEELAAQTRIRE
RAAC01352              DSRVPGEAERAVRAGSEVLRACVDAGGSITGEHGVGIEKIGEMAYMFSEDEIHAQRAVKS
ref|NP_926015.1|       DGRIAGELEKVELLGGEILKLCVAVGGSISGEHGIGAEKRCYMSDMFTPADLETMQWVRT
ref|YP_001660274.1|    DNKVEGAWEEVEELGGEILKLCVRVGGSLSGEHGIGIDKNCYMPAMFNEIDLETMGYVRD
                       *    *  *..    *.   *:  *.  .***::****:*  :*    *   :*.   ::  :     ::

ref|YP_147385.1|       VFNPKNLLNAGKLFPTPERCVETK------------------------------
ref|YP_001125498.1|    VFNPKNLLNAGKLFPTPGRCVETKQVSSTVK------------------------
ref|YP_175671.1|       VFNPDNLLNGGKLFPSPGRCVEVKK------------------------------
RAAC01352              CFDPKGIVNAGKLIPLPGRCVEVKRAREIIEENWQILNSFPDQAAVQARGAFVQEPGREA
ref|NP_926015.1|       VFDPKGLANPTKLFPTPRTCGEAARA------------------------------
ref|YP_001660274.1|    CFNPKGLANPGKLFPTPRSCGEAANAK-----------------------------
                       *:*..:  *   **:* *   * *.

ref|YP_147385.1|       ------
ref|YP_001125498.1|    ------
ref|YP_175671.1|       ------
RAAC01352              STSAQG
ref|NP_926015.1|       ------
ref|YP_001660274.1|    ------
```

FIG. 40A

```
ref|YP_001636557.1|        -------PAGVTITAPITPAYAEILTPEALEFLATLHRRFNTRRLELLARRAERQRAIDA
ref|ZP_01517435.1|         -------PAGVTITAPITPEYAEILTPEALEFLATLHRRFNARRLELLARRAERQRAIDA
RAAC01354                  MAGSYACPQGVQITGEYRPEFAEILTTDALQFIAELERRFGPRRDELLRLRKERDERLLA
ref|YP_001374183.1|        ----------VTLAGELLPSYNEILTPEALTFLKELHENFNERRIQLLKKREEKQKRIDA
ref|YP_082630.1|           ----------VTLVGEMLPAYNEILTPEALSFLKELHGNFNERRIELLQKRAEKQKRIDA
ref|ZP_01697170.1|         ---------GITVTGSIHDGYDDILTPEALQFLEQLERHFGERRRELLAYRKKRDEEIKS
                                    :  ..    :  :***.:**  *:   *. .*. ** :**  *  :::.  :  :

ref|YP_001636557.1|        GERPDFLPETAHIRESEWTIAPIPPQIQDRRVEITGPV-DRKMIINALNSGAKVFMADFE
ref|ZP_01517435.1|         GERPDFLPETAHIRESDWTIAPFPPQLNDRRVEITGPV-DRKMIINALNSGAKVFMADFE
RAAC01354                  GEWPDFLPETKEIRESEWTVGPIPADLQDRRVEITGPSSDRKMVINALNSGAKCFMADFE
ref|YP_001374183.1|        GEFPNFLPETAHIRAGNWTIAPLPRDLEDRRVEITGPV-DRKMIINALNSGAHLFMADFE
ref|YP_082630.1|           GEFPKFLEETKHIREADWTIAKLPKDLEDRRVEITGPV-DRKMVINALNSGAHLFMADFE
ref|ZP_01697170.1|         GKLPHFLEETASIRESDWTIAPLPEDLQDRRVEITGPV-DRKMVINALNSGAKIFMACFE
                           *: *.      .::. :*  :::******  :***  * ** ref|YP_001636557.1|        DANTPTWQNQVEGQINLRDALRRTITYTSPEGKHYALNNNPAILFVRPRGWHLNEKHMLV
ref|ZP_01517435.1|         DANTPTWQNQIEGQINLRDALRRTITYTSPEGKYYALNPNPAILFVRPRGWHLPEKHMLV
RAAC01354                  DACAPSWENVVQGQINMRDAVRRTIEYTSPEGKYKLNDEVAVLIVRPRGWHLPEKHIRV
ref|YP_001374183.1|        DSSSPTWKNIIEGQINLRDAAKGTISYKSPSGKEYRLGDQTAVLIVRPRGWHLEEKHMQV
ref|YP_082630.1|           DSNSPTWENAIEGQINLRDAVRGTISHKNENGKEYRLNSKTAVLIVRPRGWHLEEKHMQV
ref|ZP_01697170.1|         DATSPTWENIIEGQIHLRDAVNRTITFTGPNGKEYKLADHPAVLIVRPRGWHLEEKHILV
                           *:  :*:*:*  ::*:* .    ...  .  * *   . *:*:*******  *: * ref|YP_001636557.1|        DGEPISGAIFDFGLYFFHNAQTAIDVQGGPYFYLPKMESHLEARLWNDIFVLAQELRGIP
ref|ZP_01517435.1|         DGEPIAGAIFDFGLYFFHNAQTAIEVQGGPYFYLPKLESHLEARLWNDIFVLAQELRGIP
RAAC01354                  DGRVATGALVDFGLYFYHNAKELLARGTGPYFYLPKMESHLEARLWNDVFNYAQDALGIP
ref|YP_001374183.1|        DGKRMSGSLVDFGLYFFHNAKTLIEKGSGPYFYLPKMESYLEARLWNDVFVFAQKYVGIP
ref|YP_082630.1|           DGKNMSGSLVDFGLYFFHNAKALLEKGSGPYFYLPKMESYLEARLWNDVFVFAQKYIGIP
ref|ZP_01697170.1|         DGKPISGSLTDFGLYFFHNARRLLENSTGPYFYLPKMESHLEARLWNDVFIFAQKYIGIP
                           **.   :*::  ****:*:         ******::********:*   .   * ref|YP_001636557.1|        QGTIKATVLIETILAAFEMDEILYELRNHSAGLNCGRWDYIFSCIKKFRNDPNFCLADRA
ref|ZP_01517435.1|         RGTIKATVLIETILAAFEMDEILYELREHSAGLNCGRWDYIFSCIKKFRNDPNFCLADRV
RAAC01354                  RGTIKATVLIETILATFEMDEILYELRDHAAGLNCGRWDYIFSYIKKFRNHPEVILPDRA
ref|YP_001374183.1|        NGTIKATVLIETIHAAFEMDEILYELRDHSAGLNCGRWDYIFSFLKCFRNHKAFLLPDRA
ref|YP_082630.1|           NGTIKATVLLETIHASFEMDEILYELKDHSAGLNCGRWDYIFSFLKAFRNHNEFLLPDRA
ref|ZP_01697170.1|         KGTIKATVLIETIMAAFEMDEILYELKEHSAGLNCGRWDYIFSYIKKLRTNPQFITPDRS
                           .********:*** *:**********::*:***********  :*  :*..   . .**

ref|YP_001636557.1|        LVTMTTHFMRSYSLLAIKTCHRRGAHAMGGMAAQIPIKNDPVANEAALAKVRADKEREAS
ref|ZP_01517435.1|         LVTMTTHFMRSYSLLAIKTCHRRGAHAMGGMAAQIPIKNDPKANEEALAKVRADKEREAN
RAAC01354                  QVTMTVPFMRAYTLLTIRTCHRRKAFAMGGMAAQIPIKNDPRRKAFAMGGMAAQIPIKNDPVANEAALAKVRADKEREAQ
ref|YP_001374183.1|        QVTMTVPFMRAYSLKVIQTCHRRNAPAMGGMAAQIPIKNNPEANEIAFEKVRVDKEREAL
ref|YP_082630.1|           QVTMTAPFMRAYSLKVIQTCHRRNAPAIGGMAAQIPIKNNPKANEAAFEKVRADKEREAL
ref|ZP_01697170.1|         LVTMTVPFMRAYSLLTIKTCHRRNAPAIGGMAAQIPVKDDPAKNEEAFQKVRADKERE AR
                           **. *:*:* .*:*****  * *:********:*:.*  ** *: *.**** ref|YP_001636557.1|        DGHDGTWVAHPGLVPVAMEVFDRLMPTPNQINR-QRDDVQVTAADLLAFGPEKPITEQGM
ref|ZP_01517435.1|         DGHDGTWVAHPGLVPVAMEVFDRLMPTPNQINR-QRDDVHVTAADLLAFGPSEPITEQGL
RAAC01354                  DGHDGTWVAHPGLVPVAMEVFNRLMPTPNQLHR-LREDVQVTAADLVAV-PQGTITEGGL
ref|YP_001374183.1|        DGHDGTWVAHPGLVPVAMEVFNHIMKTPNQIFR-KREELHVTEKDLLEV-PMGTITEEGL
ref|YP_082630.1|           DGHDGTWVAHPGLVPVAMEVFNHIMKTPNQIFR-KREEIHVTEKDLLEV-PVGTITEEGL
ref|ZP_01697170.1|         DGHDGTWVAHPGLVPVALEAFNKEMPEPNQIHSGKQMDFTATADDLLAV-PQGEITEKGI
                           ****************:*.*::  *  ***:          :  :.  .*  **:  .  *    *** *:
```

FIG. 40B

```
ref|YP_001636557.1|    RLNINVGIQYLGAWLAGNGCVPVFNLMEDAATAEISRAQIWQWIRSPKGVLEDGRKVTVE
ref|ZP_01517435.1|     RLNINVGIQYLGAWLAGNGCVPVFNLMEDAATAEISRAQIWQWIRSPKGVLADGRKVTVE
RAAC01354              RTNVAVALRYIEAWLRGSGAVPIFNLMEDAATAEISRAQIWQWIHHPKGVLDDGRKVTVE
ref|YP_001374183.1|    RMNISVGIQYIASWLSGRGAAPIYNLMEDAATAEISRAQVWQWIRHEEGKLNDGRKVTFA
ref|YP_082630.1|       RMNISVGIQYIASWLSGRGAAPIYNLMEDAATAEISRAQVWQWIRHEGGKLNDGRNITLE
ref|ZP_01697170.1|     RENIYAGIQYIESWLRGRGAVPISNLMEDAATAEISRTQLWHWIRHPKGVLQDGRKVTIE
                       * *:  ..::*: :** * *..*: *************:*:*:**:    * * ***::*.

ref|YP_001636557.1|    LFRQMLPEELHKVREILG-PAYEDGRYEEAAELFDEITTDPEFVEFLTLPAYERI-
ref|ZP_01517435.1|     LFRQMLPEELAKVREILG-PAYEDGRYGEAAELFDEITTDPNFVEFLTLPAYDRI-
RAAC01354              LFRQILEEELRKLKDEIGEEAYAQSKFPLAAELLDDISTKDDFVDFLTLPGYEHLA
ref|YP_001374183.1|    LVEQLKAEELAKIEKEIGKESFEKGRFVEATKLFTDLVRKDEFEPFLTLPGYEIL-
ref|YP_082630.1|       LMEELKEEELEKIEREIGKEAFKKGRFQEATTLFTNLVRNDEFVPFLTLPGYEIL-
ref|ZP_01697170.1|     LYEQIKAEELERIRREIGEEYYRAGRFEEAVALFDRLVKEDEFIEFLTLPAYELL-
                       * .::  *** ::. :*   :   .::  *.  *:  :  . :* *****.*: :
```

FIG. 41A

```
ref|YP_895924.1|       ------------------------------------------DRVVINTTVRELHS
ref|YP_037600.1|       ------------------------------------------DRVVINTTVRELHS
ref|ZP_00235684.1|     -----------------------------------------GDRVVVNTTVRELHS
ref|YP_001646030.1|    ------------------------------------------DQVVVNKTVRELHS
ref|ZP_01724857.1|     -----------------------------------------LEEQVSTNETVRQLHG
RAAC01360              MYPFSSYMTFTRRVSPWDRRHARRRATEMEARMMTIPWETLKEELGDKLSFGESVRRSHA
                                                                 :::    .  :**. *.

ref|YP_895924.1|       KDESYHASSLPDVVVFPKTTEEVSTIMKIASEHGTPVVPFGVGSSLEGHVIPYEKGITVD
ref|YP_037600.1|       KDESYHASSLPDVVVFPKTTEEVSTIMKVASEHGTPVVPFGVGSSLEGHVIPYEKGITVD
ref|ZP_00235684.1|     KDESYHASSLPDVVVFPKTTEEVSSIMKVASQHGTAIVPFGVGSSLEGHVIPYEKGITVD
ref|YP_001646030.1|    KDESYHNSSLPDVVVFPKTTEEVRAIMKVASEHKKPVIPFGVGSSLEGHIIPYEKGITVD
ref|ZP_01724857.1|     KDESHHPMSLPDIVVFPRSTADVSAILKVAHAQRVPVVPFGVGSSLEGNAIPIANGISID
RAAC01360              KDESYHPEHLPDAVAYPEETADVVALARFSHAHGVPLVAYGAGSGLEGQVIPVRGGISVD
                       ****:*    *** *.:*. *  :*  ::  :.:   .::.:*..*:     ::* ref|YP_895924.1|       FSLMNKILEIREKDFLVKVQPGVTRSQLNKELKKYGLFFSVDPGADATLGGMAATNASGT
ref|YP_037600.1|       FSLMNKILEIREKDFLVRVQPGVTRSQLNKELKKYGLFFSVDPGADATLGGMAATNASGT
ref|ZP_00235684.1|     FSLMNKILEIREKDFLVRVQPGVTRSQLNKELKKYGLFFSVDPGADATLGGMAATNASGT
ref|YP_001646030.1|    FSLMNKILEIREKDFLVKVQPGVTRSQLNKELKKYGLFFSVDPGADATLGGMAATNASGT
ref|ZP_01724857.1|     FSEMNAILEVRPEDLLVKVQPGVTRSQLNKELKKHGLQFTVDPGADATLGGMAATNASGT
RAAC01360              FSRMNRVLEIRPDDFLVCVEPGVTRQQLNDALRPYGLMFPVDPGANASLGGMAATNASGT
                         :**:*  .*:** *:*** *  *: :** *.*****:*:************ ref|YP_895924.1|       TAVKYGVMRDQVRDLEVVLADGEVIHTGNLAAKSSSGYHLNGVFVGSEGTLGCFTELTLK
ref|YP_037600.1|       TAVKYGVMRDQVRDLEVVLADGEVIHTGNLAAKSSSGYHLNGVFVGSEGTLGCFTELTLK
ref|ZP_00235684.1|     TAVKYGVMRDQVRDLEVVLADGEVIHTGNLAAKSSSGYHLNGIFVGSEGTLGCFTELTLK
ref|YP_001646030.1|    TAVRYGVMRDQVRDLEVVLADGQVIHTGNLAAKSSSGYHLNGIFVGSEGTLGCFTELTLK
ref|ZP_01724857.1|     TAVRYGVMRDQVRDLEVVLADGSVIHTGNLAAKSSSGYHLNGLFVGSEGTLGCFTELTLK
RAAC01360              TAVRYGPMKANVRKLEVVLADGRVIEVGTLAAKSSSGYNLVELFVGSEGTLGLFTKLWLR
                       ***:**  *: :**.******** **..*.**********:*  :********* **:* *:

ref|YP_895924.1|       VYGIPEHVMAARASFPAINDAVEAVINILQAGIPIARIELVDELSMKQVNHYSETSYREE
ref|YP_037600.1|       VYGIPEHVMAARASFPTINDAVEAVINILQAGIPIARIELVDELSMKQVNHYSETSYREE
ref|ZP_00235684.1|     VYGIPEHVMAARASFPAINDAVEAVINILQAGIPIARIELVDELSMKQVNHYSETSYREE
ref|YP_001646030.1|    VYGIPEHVMAARASFPTINDAVEAVINILQAGIPIARIELVDELSMKQVNHYNETNYREE
ref|ZP_01724857.1|     VYGIPEFVTAGRAVFNTVGDAVSSVTALLQTGISVGRVELVDEASIQQANIYNDTAFSEK
RAAC01360              VYGVPEATLAASAEFATVREAVDAVCMLIGSGLQLTRCELVTKPYIEIINRQFDTSYTPA
                       ***:**   .  *. * *  ::  :**.:*  ::  :*: *  *** :  ::    *   :* :

ref|YP_895924.1|       PTLFLEFHGNEAGLKQDVEFTKEIVFDQKCKEVAFETETAARNKLWDARHNLAYAYVHSY
ref|YP_037600.1|       PTLFLEFHGNEAGLKQDVEFTKEIVFDHKCKEVAFETETAARNKLWDARHNLAYAYVHSY
ref|ZP_00235684.1|     PTLFLEFHGNEAGLKQDIEFTKEIVFDHKCKEVAFETETAARNKLWDARHNLAYAYVHSY
ref|YP_001646030.1|    PTLFLEFHGNEAGLTQDIEFTKEIVFDHKCKEVAFETETVARNKLWDARHNLAYSYVHSY
ref|ZP_01724857.1|     PTLFLEFHGNEAGMHADIAFATEIFEDFHCLSVEFEHDNAGRNKLWEARHSLAYAYMHAH
RAAC01360              PTLFLELSGSQAAVQADMGTVDEILRDAGAARVSVVMDERERQKLWHARHNAAYALMRTY
                       ******: *.:*.:  *: .  . **. *    *    *.:***.***. **:  ::::

ref|YP_895924.1|       PGKKLMSTDVCVPISELAGAIQQAKETLEKNGLVGGILGHVGDGNFHVLLMVDPNDKEEV
ref|YP_037600.1|       PGKKLMSTDVCVPISELAGAIQQAKETLEKNGLVGGILGHVGDGNFHVLLMVDPNDKEEV
ref|ZP_00235684.1|     PGKKLMSTDVCVPISELAGAIQHAKETLDKVGLVGGILGHVGDGNFHVLLMVDPNDKEEV
ref|YP_001646030.1|    PGKKLMSTDVCVPISELAGAIQHAKETLDKVGLVGGILGHVGDGNFHVLLMINPNDKDEV
ref|ZP_01724857.1|     PGKKLMSTDVCVPISMLAETILYAREQLNTVGLAGGIVGHVGDGNFHALLMLNPDDAEEQ
RAAC01360              PGLSHLSTDVCVPMSKLPEAVDVAETWIERLGIRGGIVGHVGDGNFHVSLMVNPSDPDDL
                       **  .:********:* *.::   *. :: .  *: ***:*******. **::*.* ::
```

FIG. 41B

```
ref|YP_895924.1|        EKADEINESIVLYALKRGGTCTGEHGVGIGKRKYQEEEHGAALFVMEKIKKALDPQNILN
ref|YP_037600.1|        EKADKINESIVLYALKRGGTCTGEHGVGIGKRKYQEEEHGAALLVMEKIKKALDPQNILN
ref|ZP_00235684.1|      EKADEINESIVLYALKRGGTCTGEHGVGIGKRKYQEEEHGAALFVMEKIKRALDPQNILN
ref|YP_001646030.1|     KKADEINESIVLYALKRGGTCTGEHGVGIGKQKYQEEEHGAALLVMEKIKKALDPQNILN
ref|ZP_01724857.1|      AKADRFNEHIVQYALLRGGTCTGEHGVGIGKMRYQATEHGSSLAVMKSIKIALDPLNIMN
RAAC01360               GRAYELSHHLVEYALSVGGTCTGEHGVGLGKMKYQKQEHGEALALMQAVKRLFDPADMLN
                         :*  .:.. :* *  ********:  :   * :* :*:  :*   :** :::* ref|YP_895924.1|        PNKV-----
ref|YP_037600.1|        PNKV-----
ref|ZP_00235684.1|      PNKV-----
ref|YP_001646030.1|     PNKI-----
ref|ZP_01724857.1|      PGKI-----
RAAC01360               PGKLVDGIA
                        *.*:
```

FIG. 42

```
ref|YP_701593.1|    ------------------------QRIEDDEQVPHDIVMPILERIGALGLLVPREYGGSG
ref|YP_885121.1|    ------------------------ERIENEERIPNEIVLPILERIGAFGLLVPREYGGSG
ref|YP_872951.1|    --------RREVEEFVRGPGERYAEQIEAENRVP-ESLWTELRDRGYLRLAAPQEYGGRG
gb|AAQ84159.1|      -----------VERWVEGPGERWAERIEETGEVP-EAVWSELDELGFLRLAAPVEYGGQG
RAAC01408           MMRTLDEWKKDVDAYVAGPARAWSEHIEATGTVP-DALWRELRDAGYLRLAAPPHLGGHG
ref|ZP_02169377.1|  -----------VRQFAAERVAPFVEEMEMNETFP-DALLREMGELGLLGIPVEEEHGGAG
                                :.:*    .*  :  :      *  :  .     . ** * ref|YP_701593.1|    LSIAQYLPIIAEFAKVQGALRVIVHVHNSFAH-ALSEIGSDRQKADVLPGTATGRNSVAF
ref|YP_885121.1|    LSIAQYLPIISEFAKVQGGLRVIVHVHNSFAH-ALSEIGNDEQKAAVLHGAATGANSVAF
ref|YP_872951.1|    LQFSKYLELVELFAMSHASLRMIVHVVNGIWR-AIDQLATDEQRKKFVLPQVAGDIRVAF
gb|AAQ84159.1|      LGFTQWMELMEIFSRSHGSLRMIVHVVNGIWR-SMDGHACDEQRKRFVVPSVLGEIKIAF
RAAC01408           LSFTDYLDLLRRFAHTHGSIRVMVHVANSLWR-SLAQKATPEQVERFVKPFVAGDIRVTF
ref|ZP_02169377.1|  MDFTSYIIAIHELSKVSATLGVILSVHTSVGTNPIRYYGTADQISRYVPKLASGEWLGAF
                    :  ::.::    :     :  :: *  ..       .:      *       :  . *   :* ref|YP_701593.1|    ALTEPGFGT-GADLGSTAVREGDGYILNGEKWLITNSDIASHFIVFAKTTATD----VSA
ref|YP_885121.1|    ALTEPGHGT-GADLGSSAVRMGDEYEITGEKWLITNSDIATHFIVFAKTAPTE----VSA
ref|YP_872951.1|    TLTEPTAGT-GADIRSTVVRDGDTYYLTGEKHLITFGVRCDYWLLFARVAGTTGKDGTVA
gb|AAQ84159.1|      ALTEPGNGT-GADITTSVVREGDTYYLSGRKHLITFGMRCDYYLLAARVAGSAGHEGTVA
RAAC01408           TLTEPNSGS-GADIKTTARREGDEYVLNGEKWMIIFSDVADYFLLFCRLEGTSGGEGTLA
ref|ZP_02169377.1|  ALSEPGAGSDAASLRTTAKKDGDHYILNGSKAWITNGGYADTYIVFAKTDPDAGKKGITA
                     :*:**   *: .*.: ::. : ** * :.* *   *     .    :::    .:       * ref|YP_701593.1|    FLVPRETDGLSIAALPETMGCKGTEHGRVTLDSVRVPATALVGVEGQGNEHLERA-LEIS
ref|YP_885121.1|    FLVPRDTDGLSIEPLPETMGCKGGEHGHIRLAGVRVPATALIGAEGEGNQHLERA-LEIS
ref|YP_872951.1|    LMVDRHSPNVVVKEMSPSMGVRGTDHAHLIFRETPVPVANRLGAEGEGLDVAFGGFLTPS
gb|AAQ84159.1|      LLVPRNAPGVSAEDTSRTMGVTGTDHASIVFDRTPVPVDHRLGEEGQGLEVFLGGFLTPS
RAAC01408           LLVPRDAPGLTVELMAPAMGIAGTAHGHLRLRDCRVPVANRLGEEGDGLEVAFRGFLDPS
ref|ZP_02169377.1|  FIVEKDTPGFTVLAKERKMGLLGSSTTGLAFEDCRIHESRRLGEEGQGYTIALSN-LDYG
                     ::*  :.:  ..      **   *    :  :        :*  **:*         *  .

ref|YP_701593.1|    RVFIAASSLGTSERALELSIAHAKSRVTFGKPIGTRQAIQRYLAEMATDVYALRGILADA
ref|YP_885121.1|    RVFIAASSLGTSERALELSVARAKERVTFGKPIGSRQAIQRYLAEMATDIYALRGLLADA
ref|YP_872951.1|    RISVAMTCVGLARRAQELAVEYAKQRVTFGKRLADRQVIAYALAENATDIEAARQLTLYA
gb|AAQ84159.1|      RISVAMSCVGLAQRAQQLAVDYARSRVTFGKSLTERQAIQFMLAENAADIEAARQLVLHA
RAAC01408           RTAIGMTCVGAAERALELAADHALRRVTFGQPLAKRQIIQMWLAEMATDIEAARQLVLHA
ref|ZP_02169377.1|  RVGIAAQALGIAEAALEHATDYAKERKQFGKPIAMQQGLAFKLADMATAVEAAKLLTYSA
                    *   :.    ..:* :.  * : :     *   *   **:  : *  :   **: *:  *  : :      * ref|YP_701593.1|    AQKWDAGER-IPAEASMCKLFGLEAVGRVTDRALLIHGGIGYTRAHPIERLYRDARLNWL
ref|YP_885121.1|    AHKWDSGKR-IPAEASMCKLFGLEAVGRVTDRALLIHGGIGYTRAYPVERLYRDARLNWL
ref|YP_872951.1|    ARQWESGAADALTLSSMAKLNAVDMLTRVTDKALQIHGGIGYFQSSPIERVYRDARQRF
gb|AAQ84159.1|      ARRFEEGADDASMQSSMAKMHAVTMLTTVTDKALQVHGGLGYWKSQKIERVYRDARAQRF
RAAC01408           ARRFDEGHP-ITVEAAMAKMFATEMLQRVTDKALQIHGGPGYFKSSEIERIYRDARMQRF
ref|ZP_02169377.1|  ANRKDQGLT-TGIEASMAKTFASDTAMKVTTEAIQVFGGYGYTKDYPVERFFRDAKVTQI
                    *.: : *         ::*.*  .        ** .*: :.** **  :    :**.:***:    :

ref|YP_701593.1|    EEGTPTIQYLVTAGRLLD--------------
ref|YP_885121.1|    EEGTPTIQYMVAANELL---------------
ref|YP_872951.1|    EEGTNEIQKTVIARSVL---------------
gb|AAQ84159.1|      EEGPNEVQKAVVFRELLRQAGTVTAGGAR---
RAAC01408           EEGTSEIQKMVIARDVIDKAKRASEGSERRCW
ref|ZP_02169377.1|  YEGTNEIQRIVIAGQLL---------------
                    **. :*  *    ::
```

FIG. 43

```
ref|YP_146050.1|        -----MDFTLPAEIEFLKENVRKFVREVVEPVAMDIEENDQIPQDIIEKSKEMGLFGLSI
ref|YP_001124307.1|     -----MEFTLPAEIEFLKENVRKFVREVVEPVAMDIEENDHIPEDIIEKSKEMGLFGLSI
RAAC01425               MEVSRVDFTLPSELEEMRRTIRDFVEHEVEPLAMQIEEEDRVPDSVLEKSKELGLFGLSI
ref|NP_691609.1|        -----MNFELDEDIQIIKDNVRNFIQTEVEQVADNIERNNKIPDRIIELSKQMGLFGLSI
ref|YP_360564.1|        -----MDFTISEELQMMVQTVKDFVDNEVDPISQQIDEEDRVPEEIIQKARELGLFGLSI
ref|NP_294646.1|        -----MDFNLPDDLREVQATIRDFMLTRVEDRAQEIEHTNSVPPELIKEAADLGLFGLSI
                              ::*  :    ::. :   .::.*:    *:    : :*:.  : :*   ::: : ::******* ref|YP_146050.1|        PEEYGGLG-LSMVGKCAIYEELGKTHNGYTTLIGAHTGIGTVGIVELGTEEQKQRYLPKM
ref|YP_001124307.1|     PEEYGGLG-LSMVGKCAIYEELGKTHNGYTTLIGAHTGIGTVGIVELGTEEQKQRYLPKM
RAAC01425               PEEYGGIG-LSMLGKCVIYEELGKTINGYTTIIGAHNGIGSVGIVEFGTKEQKEKYLPKM
ref|NP_691609.1|        PEQYGGLG-IGMVGKCALYEEIGVTHNGYTTLIGAHTGIGTVGIVEMGNEQQKQKYLPLM
ref|YP_360564.1|        PEEYGGVGSIGMLGKCIIYEQLGRTANGFTTLIGAHTGIGTTGIVELGTEEQKRRYLPDL
ref|NP_294646.1|        PEEYGGVG-LSSLGRCAVYEAMGQGHMGFGGMISAHASIGTSGLVKLGNEEQKQRFLPRM
                        **:****:*  :.  :*:*  :**   :*       *:    :*.**  .**: *:*:*.**.::** :

ref|YP_146050.1|        ATGEWIGAFALTEPSAGSNAAAIKTTAVRKGDRYIINGSKHYITNAVDAHVFTVMAVTDP
ref|YP_001124307.1|     ATGEWIGAFALTEPSAGSNAAALKTTAVRKGDRYIINGSKHYITNAVDAHVFTVMAVTDP
RAAC01425               ATGEWIGAFALTEPQAGSNAAAIKTTAVKKGDRYILNGQKIYITNAPYAHVFTVMAVTDP
ref|NP_691609.1|        ASGEKIGAFALTEPEAGSNASALKTSAIKKKDKYILNGTKHYITNATEAEVFTVMAVTDP
ref|YP_360564.1|        ASGKKLAAFALTEPEAGSDAASIRTTAVKKGDRYILNGVKHFITNGPDADVFTIIAVTDK
ref|NP_294646.1|        AAGECIAGFAITEPSSGSDAGNIRTKAVKKGDVYVLNGTKHYISNAPIAGLLTVIAITDP
                        *:*:  :..**:***.:**:*.   ::*.::*  *  *:** *  :*:*.   *  ::*::*:**

ref|YP_146050.1|        SKGPKG-ITSFIVE-KDFPGFIVGKVERKMGLRGSHSAELFFDNLEVPAENVLGREGEGY
ref|YP_001124307.1|     SKGPKG-ITSFIVE-KDFPGFTIGNVERKMGLRGSHSAELFFDNLEVPVENVLGKEGEGY
RAAC01425               SKGAKG-ITSFIVE-RDFPGFRVGHIEKKMGLHGSHTAQIFFEDMEVPEENVLGREGEGY
ref|NP_691609.1|        AKGAKG-ISSFIVE-KSNLGFHVGAVEEKMGLKGSHSAEIILDDCEVSVENLLGEEGQGY
ref|YP_360564.1|        SKGAKGGITAFIVE-KNFPGFKVGTIEKKMGLRGSHTSEIILEDCEVPEENVLGNVGEGY
ref|NP_294646.1|        AQGSRG-MSAFLVEPQSTPGVSIGKIDEKMGQKGALSAEVIFEDAEIPAANLLGPENRGY
                        ::*.:*  :::*:**  :.   *.  :*  ::.***  :*:  ::::::::: *:. *:**   ..**

ref|YP_146050.1|        VNALKILANGRAGLAARNLGSCIRLLEYCMEYAEQREQFGKPIIEQQAIQHMLAEMSMLI
ref|YP_001124307.1|     INALKILANGRAGLAARNLGSCIRLLEYCMEYAEQREQFGKPIIEQQAIQHMLAEMSMLI
RAAC01425               VNALKILANGRAGLAARCLGSCEYLLDKSLAFAHERIQFGKPIFEQQIIQHYLAEMALEI
ref|NP_691609.1|        VNALKILTNGRAGLAARNLGSCQKLLDMSTTYAIERQQFGTSIIDHQAVAHMLAEMAVEI
ref|YP_360564.1|        INALKILAKGRVGLAARCVGSMQKLLELSTRYAQQRVQFGKPISSFQAIQHMLAEMAVDI
ref|NP_294646.1|        REALGILTNGRVGIAARSTGAMQRLLDLSVAHAQTREQFGKPIAEFQAVQFMLAEMEVAI
                        : ::**.*:***  *:       **: . .*  * ***..*  . * :  ****  : * ref|YP_146050.1|        EVLRSTVYRVAWMVDQKMRVVKEAAIAKLFGSEVYNKIADMAVQIHGGLGYMKDYPIERY
ref|YP_001124307.1|     EVLRSTVYRVAWMVDQKMRVVKEAAIAKLFGSEVYNKIADMAVQIHGGLGYMKDYPIERY
RAAC01425               ELLRTFVYRVAWMTDQKMNVIKEAAMLKLYGSEVYNRVADKAVQIHGGLGFIAEYPIERF
ref|NP_691609.1|        EALRALTYKVAWMVDNGENVIKEAAMLKLYGSEVYNRVADKAVQVHGGIGYISDFPVERY
ref|YP_360564.1|        EATRWFAYRVAWLVDQGAKVIKEAAAVKLFASEAYGRVVDKAVQIFGGMGYMKEFPIERY
ref|NP_294646.1|        QTSRVLWQKVAWMVDQGQDVKRMASVAKYHATEMLSQVADKAVQVAGGMGYVKDAPFERF
                        :    *       :***:.*:      * : *:    * ...:*  .::.* ***  **:*::  :  *.**:

ref|YP_146050.1|        FRDARITKIYEGTSEIQRNIIASELRKEYGKVRA--
ref|YP_001124307.1|     FRDARITKIYEGTSEIQRNIIANELRKEYGKVR---
RAAC01425               YRDARITRIYEGTSEIQKNIIAAQLHKEYERTKADA
ref|NP_691609.1|        YRDARITRIYEGTSEIQKNIIAGQLKKHY-------
ref|YP_360564.1|        YRDARITRIYEGTSEIQKNIIASQILKE--------
ref|NP_294646.1|        YRDQRLLRIYEGTSEIQKVIIAAEL-----------
                        :** *:*:*********: *** ::
```

FIG. 44

```
ref|YP_902570.1|         ---------------IIIAPDSYKGSLSAVEVAEAMARGIVSVFPDAEIVSLPVADGGEG
ref|ZP_01667660.1|       ---------------VVIAPDSFKGSVSALGVANAVANGVRAVFPDAEIIKVPIADGGEG
ref|YP_429281.1|         ---------------IVIAPDSFKESLSAPEVAAAIAQGIHRVLPEVETVNVPMADGGEG
ref|YP_076319.1|         ---------------IIVAPDSFKGSLTALKAAEAMRQGVLDAMPDAEVVALPMADGGEG
ref|YP_001629366.1|      ---------------IIIAPDSFKESLSAPDAAAAIERGVKQAFPGARTLCVPMADGGEG
RAAC01517                MTHVTSIGAKGEAPHILLAPDSFKGSLTAREAAEAMAEGVSRACPSAQLALVPIADGGEG
                                        :::****:* *::*  .* *: .*:  . *  ..  :*:****** ref|YP_902570.1|         TVEALVAATSGRFVCQEVSGPLGEPVMARWGILGDGATAVIEMAAASGLPLVAPERRNPL
ref|ZP_01667660.1|       TVEALVTATGGQIVTREVVGPLGEPVMAHWGVLGDGDTAVIEMAAASGLTLVPKEKRDPR
ref|YP_429281.1|         LTATLVAATGGREMTATVTGPLGEPVQASWGILGDGITAVVEMAQASGLPLVPREKRNPL
ref|YP_076319.1|         TTQALVAATGGQLVEAEVTGPLGEPVRAAFGLLGDGDTAVIEMAAASGLLLVPPERRDPK
ref|YP_001629366.1|      TVAAVLAATGGQWRTTPVSGALGEPMQAAWGWLDDS-TAVIEMAAAAGLEQTPPERRDPL
RAAC01517                TLAAIATSTRARWLSTEVTAASGQPKQGRFLALPDG-TAVVECAEAVGLPEALRSGADVW
                         ::  ::*  .:        *    *:*    . :   * *. ***:* * * **   ..   :

ref|YP_902570.1|         RASTCGTGELIRAALDAGLRRLIVGIGGSATNDGGAGMARALGVRFLDADGTELPEGGAA
ref|ZP_01667660.1|       ITTTYGTGQLIKAVLDRGIRKIIIGIGGSATNDGGTGMAKALGARFLDASGQELPPGGAA
ref|YP_429281.1|         VTTTYGTGELIHQALEAGCRRLIVGIGGSATNDGGAGMARALGVKLLDAEGADIPPGAGG
ref|YP_076319.1|         VTTTYGTGTELIRAALDRGVRRILVGIGGSATNDGGVGMAQALGGRFLKADGSPVDRGGA
ref|YP_001629366.1|      RASSGGVGELLRAALDAGARRIILGLGGSATNDGGAGMLAALGVRFLDANGLDLPPGGAA
RAAC01517                RRTTVGVGEMIRHALETGHRRIAVALGGSATNDAGVGMLAALGVRLLDDAGQDVPPVPAE
                         ::  *.*::::  .*: *  *::  . :.:*******.*.** *** ::*.  *  . .

ref|YP_902570.1|         LARLARVDLDGLDPRLVETSLQVACDVTNPLCGENGASVIYGPQKGATPEMVRELDRALE
ref|ZP_01667660.1|       LARLAKIDLSGLDERLRTTTILVACDVDNPLCGPRGASAVYGPQKGATPEMVKELDAALK
ref|YP_429281.1|         LERLERIDIQGLDPRVKEVEILVACDVDNPLCGPRGASAVYGPQKGATPEMIPRLDAALA
ref|YP_076319.1|         LLELERIDLSGLDPRLKGVELMVACDVDNPLTGPRGASAAAVYGPQKGATAEDVALLDRALT
ref|YP_001629366.1|      LQQLARIDVQGLDPRLAGVQIDIASDVDNPLCGPQGASHTFGPQKGASPEQVALLDRSLA
RAAC01517                FHRVARVDVSGLDERLRGAEMLAVCDVDNPLTGENGATTVFGPQKGVSTHDVPRLDEALA
                         :  .: ::*:.***  *:    .  :   .. *  . :  :*.::.. :    :* ref|YP_902570.1|         HYSQVVEQAIARNVSDQAGSGAAGGLGAGLRYFTNASLLPGVKIVLDAVGFAEALKT-AD
ref|ZP_01667660.1|       NFAAVATVATGKDVADYPGAGAAGGLGAGLLFFTGAQLRPGVEIVLETTGFASLVAT-AD
ref|YP_429281.1|         RLADIVARDLKVDVRELPGAGAAGGLGAGLVAFLGATLRRGIELVIEAVNLDGILAAGAD
ref|YP_076319.1|         RLADVMRDLGRDVRNLPGAGAAGGLGAGLMGFLGARLRPGIDVVMEVTGLRRQLQG-AA
ref|YP_001629366.1|      RLADVCARDLGRDMRDAPGAGAAGGLGYAAHAFLNARFRPGVELVAELGKLAQAMEG-AA
RAAC01517                HLAARCEAAFGCKAADLPGAGAAGGLGFALY-LLGAARVSGIDFVLDAVGFDHALER-AA
                           . :         . .*:*******  .    : .*   *:..*  :     :    * ref|YP_902570.1|         LVITGEGCSDAQTAHGKAPLGVARLARNGGVPVICLSGGLGAGAEQLLEHGIDALLGIVS
ref|ZP_01667660.1|       LVITGEGRTDFQTAYGKAPVGVAKVAKQYGVPVVCLSGGLGDGADDVLAQGVDALMSVVP
ref|YP_429281.1|         LVITGEGEINRQTAYGKVPAGVAGVAAKYGIPVVALVGSIGEGASAVYDHGIQGFMSIVP
ref|YP_076319.1|         LLLTGEGRTDGQTLAGKVPLGLARAAAPCGVPVVVISGAVTDDADALLEQGVAALLSTAP
ref|YP_001629366.1|      LAFTGEGRMDAQTLRGKTPAGVARIARRAGVPVVALAGSLGEGYQDLHAGGITAAFSLAP
RAAC01517                LVLTGEGRTDAQTAHGKAVAGVARRAKARGVPVFCISGAIGPGAERLYDHGVSALFATAP
                         * :****  :  ** **.   *;* * *:**.  : *.:    .. :   *:. .: ..

ref|YP_902570.1|         CPMPLED-----------------------
ref|ZP_01667660.1|       QPMALDE-----------------------
ref|YP_429281.1|         RPVPL---------------------------
ref|YP_076319.1|         GPVTLDE-----------------------
ref|YP_001629366.1|      GPVSLQQ-----------------------
RAAC01517                GPIALDEAMANAKALLAAAAENAVRAWLAGRP
                         *:.*
```

FIG. 45

```
ref|ZP_01666747.1|        --TVRLDIVTPERLAYSDDVNMVIARATDGDIGILPGHAPLIAGLEIAPLRI-LKDDGEK
ref|ZP_01188594.1|        --TIRLEVVTPEKVVFSEPVNILIAPAIDGEIGILPKHTPLVTGLKTGVMRVK-KDGEEV
pdb|2QE7|H                MATVQVDIVTPERKVFQGEADIVIARGVEGELGVMAGHIPLVTPLKTAPVRIKQGD-KET
sp|P22480|ATPE_BACPF      MSTIRVNVVTPDGKVYDGDVDMVVVRTVEGELGILPKHIPLVAPLTVGAVRLKKGN-SEE
RAAC00449                 MLTVPLEIVTPERIVLSMDVRMVILRGGDGEIGILPRHMPLATAVKPCLVRIRLADDRQD
ref|YP_521144.1|          --TFTLRVVSPEGNVLKEEAEFVVLPGGNGEIGILPNHAPLISSIEIGVIRYTV-NGKVE
                            *. : :*:*:   . .  .:::    :*::*::. * **  :  :      :*     :

ref|ZP_01666747.1|        RIA-VCGGFIEVRPDKVTVLAGCAELPEEIDVKRAEAARERAE---ARL-KYREGIDVAR
ref|ZP_01188594.1|        KIS-ISEGFMEVKPDEINVIVRTAELPHEIDVERARDALKRAE---KRLNSRNDRIDRAR
pdb|2QE7|H                LIA-VSGGFLEVRPDKVNILADTAELPEEIDVERAKKAKARHETILKRL--DKTDKDYLR
sp|P22480|ATPE_BACPF      QVA-VSGGFVEVRPDQVTILAEAAELPSAIDVDRARAAK---------------------
RAAC00449                 VVP-VSGGFVEVLPEKITILADTAELPEEIDVDRALRAKDRAE---KRLQAAVDEEEADR
ref|YP_521144.1|          KIA-TSGGFVEVSDNKVTILADTAEPGEKVDLDRALAAK---------------------
                          :.  . :  :::.::.  **    :*:.** * ref|ZP_01666747.1|        AEQALKRALMRLSVAEYHKKM-----------
ref|ZP_01188594.1|        ARAAFERAIARLKA------------------
pdb|2QE7|H                HKRALERAEVRLQ-------------------
sp|P22480|ATPE_BACPF      -----ERAESRL--------------------
RAAC00449                 ARQALTRAELRLQAVEEHKRLNGFLHASVPSA
ref|YP_521144.1|          -----ERAEKRL--------------------
                                
```

FIG. 46A

```
sp|P23630|DCDA_BACSU    ------------------------------------------------------------
ref|NP_390219.1|        ------------------------------------------------------------
ref|YP_001421740.1|     ------------------------------------------------------------
ref|YP_079644.1|        ------------------------------------------------------------
ref|YP_001487298.1|     ------------------------------------------------------------
RAAC01555               MFWLLPRYAPGLTQFAVAHVDGARIYLCLNLYSGPVHRSCRRASCKRETIGVDGVKSEHL sp|P23630|DCDA_BACSU    ------------QNQHGHLEIGGVDALYLAEKYGTPLYVYDVALIRERAKSFKQAFISAG
ref|NP_390219.1|        ------------QNQHGHLEIGGVDALYLAEKYGTPLYVYDVALIRERAKSFKQAFISAG
ref|YP_001421740.1|     ------------QNKLGHLEIGGVDALYLAEHYGTPLYVYDVALIRERAKSFKQAFIDAD
ref|YP_079644.1|        ------------QNERGHLEIGGVDVLSLAERYGTPLYVYDVALIRERARKFQKAFKEAG
ref|YP_001487298.1|     ------------QNELGHLEIGGVDAVSLAETYGTPLYVYDVALIRERAKSFQKAFIEEE
RAAC01555               LDVRPRVDAHFPRDEKGHLLIGGVSAVDLVAQFGTPLIAYDEGLIRDTIRAFHRVFQDEG
                                    ::: *** ****..:  *.   :**** .**  .***:    : *::.* .

sp|P23630|DCDA_BACSU    LKAQVAYASKAFSSVAMIQLAEEEGLSLDVVSGGELYTAVAAGFPAERIHFHGNNKSREE
ref|NP_390219.1|        LKAQVAYASKAFSSVAMIQLAEEEGLSLDVVSGGELYTAVAAGFPAERIHFHGNNKSREE
ref|YP_001421740.1|     LKAQVAYASKAFSSVAMIQLAEQEGLSLDVVSGGELFTAVAAGFPADRIHFHGNNKSEEE
ref|YP_079644.1|        LKAQVAYASKAFSSVAMIQLAEQEGLSLDVVSGGELFTAIKAGFPAERIHFHGNNKSPEE
ref|YP_001487298.1|     LTAQVAYASKAFSSIAMFQLAKEEGLSLDVVSGGELHTAICAGFPVEKIHFHGNNKSRDE
RAAC01555               VPYQISYASKAFCTMAICQLAHEEGLGIDVVSGGELYTALAAGVPASKLHMHGNNKTPEE
                          :  *::******..::*: * .:*.:******.: **.*..:.:*:*****: :* sp|P23630|DCDA_BACSU    LRMALEHRIGCIVVDNFYEIALLEDLCKETGHSIDVLLRITPGVEAHTHDYITTGQEDSK
ref|NP_390219.1|        LRMALEHRIGCIVVDNFYEIALLEDLCKETGHSIDVLLRITPGVEAHTHDYITTGQEDSK
ref|YP_001421740.1|     LKMALDHQIGCIVVDNFYEISLLAELCRKSGRTMDVLLRITPGVEAHTHDYITTGQEDSK
ref|YP_079644.1|        LAMALEHQIGCIVLDNFHEIAITEDLCKRSGQTVDVLLRITPGVEAHTHDYITTGQEDSK
ref|YP_001487298.1|     LKMALENEIGCIVVDNFYEMKLLEELGQELSKQVKVLLRITPGVEAHTHDYITTGQEDSK
RAAC01555               LEYAIESGIGAVIVDNFDEIDLLADILQETGRTVDVLVRVAPGVEAHTHDYISTGQQDSK
                        *  *::  .::::* *: :  :: :. .: :.**:*:*********:*:*** sp|P23630|DCDA_BACSU    FGFDLHNGQTERAIEQVLQSEHIQLLGVHCHIGSQIFDTAGFVLAAEKIFKKLDEWRDSY
ref|NP_390219.1|        FGFDLHNGQTERAIEQVLQSEHIQLLGVHCHIGSQIFDTAGFVLAAEKIFKKLDEWRDSY
ref|YP_001421740.1|     FGFDLHNGQIEKAIEQVLQSDHIRLLGVHCHIGSQIFDTAGFVLAAEKIFAKLNEWRESF
ref|YP_079644.1|        FGFDLHNGQVEQAIEQVLRSSAFKLLGVHCHIGSQIFDTAGFVLAADKIFEKLAEWRETY
ref|YP_001487298.1|     FGFDLHNGQADEAVKRVLESEVIELLGVHCHIGSQIFDTAGFVLAADKIFLKLNEWRESF
RAAC01555               FGFDLASHQVEEAFSRLKEVERARVIGVHAHIGSQIFDVEGFRLLADRMAGVYEDGLRRF
                        *****  . *  :.*...::  .   .::***.********. ** * *:::      :     :

sp|P23630|DCDA_BACSU    SFVSKVLNLGGGFGIRYTEDDEPLHATEYVEKIIEAVKENASRYGFDIPEIWIEPGRSLV
ref|NP_390219.1|        SFVSKVLNLGGGFGIRYTEDDEPLHATEYVEKIIEAVKENASRYGFDIPEIWIEPGRSLV
ref|YP_001421740.1|     GFVSEVLNLGGGFGIRYTEEDEPLHPAVYVEKIIEAVKENAALHAFDIPEIWIEPGRSLV
ref|YP_079644.1|        SFIPEVLNLGGGFGIRYTKDDEPLAADVYVEKIIEAVKANAEHFGFDIPEIWIEPGRSLV
ref|YP_001487298.1|     GFISTVLNLGGGFGIRYTEEDEPLPATEYVEKIIQAVKENVARYEFDMPEIWIEPGRSLV
RAAC01555               GLPFSVLNLGGGFGIPYTDEDAP-PVADLVRGVIRAAKAAFAARGMDVPVLWIEPGRSIV
                         .:   ******** .:*  *      *. :*.*.*         :*:* :*******:* sp|P23630|DCDA_BACSU    GDAGTTLYTVGSQKEVPGVRQYVAVDGGMNDNIRPALYQAKYEAAAANRIGEAHDKTVSI
ref|NP_390219.1|        GDAGTTLYTVGSQKEVPGVRQYVAVDGGMNDNIRPALYQAKYEAAAANRIGEAHDKTVSI
ref|YP_001421740.1|     GDAGTTLYTIGSQKEVPGTRKYAAVDGGMSDNIRPALYQAKYEAVSANRIGEHHDKTVSI
ref|YP_079644.1|        GDAGTTLYTIGSQKEVPGIRKYVAIDGGMSDNIRPALYEAKYEAAVANRMNDACHDTASI
ref|YP_001487298.1|     GDAGTTLYTIGSKHVPGIRDYVAVDGGMSDNIRPALYQAKYEAASANKMSQSHDQTVSI
RAAC01555               GPAGVTLYRVGSRKVIPGVRNYVAIDGGMTDNPRLALYGAKYHACYANRAADPPDRPWSV
                        * **.*** :** * :** *.*.*:****.** *  *** ***.*  **:    :  . .*:
```

FIG. 46B

```
sp|P23630|DCDA_BACSU     AGKCCESGDMLIWDIDLPEVKEGDLLAVFCTGAYGYSMANNYNRIPRPAVVFVENGEAHL
ref|NP_390219.1|         AGKCCESGDMLIWDIDLPEVKEGDLLAVFCTGAYGYSMANNYNRIPRPAVVFVENGEAHL
ref|YP_001421740.1|      AGKCCESGDMLIWDIDLPEVKEGDLLAVFCTGAYGYSMANNYNRIPRPAVVFVEDGEAHL
ref|YP_079644.1|         AGKCCESGDMLIWDLEIPEVRDGDVLAVFCTGAYGYSMANNYNRIPRPAVVFVEDGEAQL
ref|YP_001487298.1|      AGKCCESGDMLIWDIDLPELSQGDLLAVFCTGAYGYSMSNNYNRIPRPAVVFVEDGEAQL
RAAC01555                AGKCCESGDMLIWDLPLPDPQPGDLLAVFATGAYTYAMASHYNRIPKPAVVFCRDGEARL
                         **************: :*:   :.** *:*:.:***:* .:*:* sp|P23630|DCDA_BACSU     VVKRETYEDIVKLDLPFK
ref|NP_390219.1|         VVKRETYEDIVKLDLPFK
ref|YP_001421740.1|      VIRRETYEDIVKLDLPFK
ref|YP_079644.1|         VIQRETYEDIVKLDLPLK
ref|YP_001487298.1|      VVERESYADMVKLDLP--
RAAC01555                VARRETWADVARLDVPLR
                         * .**:: *:.:**:*
```

FIG. 47A

```
ref|YP_001420375.1|    MFQYEELNKQFIGGRWRDGSSRNVLENRNPYTQKVITSFQKATSDDVDAAYRAAALAKQE
ref|NP_388616.1|       MFQYEELNKQFIGGKWQEGSSPNVLENKNPYTQKTFTTFRKATADDVDEAYRAAALAKKK
ref|YP_077980.1|       MIQITDLNRQYIGGEWRDGQSESVLADLNPFTHKTIASFRKATREDVDAAYKAALEAKKK
ref|NP_241871.1|       MFNIQDLNKQYIDGEWRDGKSPRVLRDRNPYNQEVLAEFQIATDSDVDAAYHAALKAQNE
ref|NP_693628.1|       -----QLDSQYINGVWKDGNGKATIQNTNPYSGEVIATYRAASLQDLDDAYETAQEVQKA
RAAC01575              MLDLRQLSRQYIAGEWRDGRSSRVHRDLNPFDGSTVAEIRLATVEDIDQAYRAAAEAQKV
                            :*. *:*  * *::*      .  .  :**   ...:   : *:  .*:*  **.:*   .:

ref|YP_001420375.1|    WDKVNPFKKRAILEKAVSFIEEHEEAIIYLIMEELGGTRLKAEFEIGLVKNMIKEAATFP
ref|NP_388616.1|       WDAVNPFEKRTILEKAVTYIEENEEAIIYLIMEELGGTRLKAAFEIGLVKNIIKEAATFP
ref|YP_077980.1|       WDGVNPYEKRAILEKAAAYIEDNREAIVFLIMEELGGTRLKAAFEIDLVVNMIKEAAGFP
ref|NP_241871.1|       WATVNPYRKREILERAVTYIEEHEEEIVAIIIDELGGTRLKAAFEIGLVKNMIKEASTFP
ref|NP_693628.1|       WAKENPITVQRIMDKAVTYMEENHEEIVDIIIQEIGGTRLKAEFEIGLVTNMIKEASSFP
RAAC01575              WAQVNPFERQAVMERALQIWEGYRDEVISLVADEIGGTFIKAAIEFELVKNFLREAATYP
                       *    **   :   :::*    *   .:  ::  ::  :*:*  :   :** *:::**:  :* ref|YP_001420375.1|    VRMEGKILPSTIDGKENRLYRIPAGVVGVISPFNFPFFLSMKSVAPALGAGNGVVLKPHE
ref|NP_388616.1|       IRMEGKILPSTIDGKENRLYRVPAGVVGVISPFNFPFFLSMKSVAPALGAGNGVVLKPHE
ref|YP_077980.1|       LKMEGKILPSPVDGKENRIYRIPAGVVGVISPFNFPFFLSVKSVAPALGAGNGVVLKPHE
ref|NP_241871.1|       LRMEGKILPSTENGKENRLYRVPAGVVGVISPFNFPFFLSVKSVAPALGAGNGVVLKPHE
ref|NP_693628.1|       MRMSGSILPSPIDGKENRVYRVPVGVVGVISPFNFPFFLSMKSVAPALATGNAVVLKPHE
RAAC01575              LRMEGRLLPATIPGKENRLLRLPAGVVGILSPFNFPMCLSMRALAPAIACGNGVVLKPHE
                       ::*.*  ::.   ***:  *:.*.**::**:  :::.*:.  .******* ref|YP_001420375.1|    ETPICGGTLIAKIFEAAGVPDGLLNVIVTDIGEIGDSFVEHPVPRIISFTGSTGVGSYIG
ref|NP_388616.1|       ETPICGGTLIAKIFENAGIPAGLLNVVVTDIAEIGDSFVEHPVPRIISFTGSTKVGSYIG
ref|YP_077980.1|       ETPICGGTLIAKIFEEAGLPKGLLNVVVTDIGEIGDSFVEHPIPRIISFTGSTKVGSYIG
ref|NP_241871.1|       ETPITGGTLIAKIFEEAGVPKGLLNVVVTEIDEIGNAFVEHPIPRIISFTGSTNVGSHIG
ref|NP_693628.1|       HTAITGGTMIAKIFEEAGLPKGVLQVVTTEISEIGDRFVDHPVPAAISFTGSTKVGKHIG
RAAC01575              EAAITGGALLAKVFEEAGVPKGLVNIVVADVAEIGDAFLEHPIPRIISFTGSTAVGRHIA
                        .:.*  ** **::** :**:* *:::::.::: ***: *::**:*  *******  **  :*.

ref|YP_001420375.1|    QLAVKHFKKPLLELGGNSALIVLEDADLEYAVNAAVFSRFTHQGQICMSANRVLVHTSVY
ref|NP_388616.1|       QLAMKHFKKPLLELGGNSAFIVLEDADIEYAVNAAVFSRFTHQGQICMSANRVLVHSSIY
ref|YP_077980.1|       QLAIKHFKKPLLELGGNSALIVLEDADLEYAVNAATFSRFTHQGQICMSANRILVQKEVY
ref|NP_241871.1|       QLAVKHFKKPLLELGGNSAFLIFADADLDYAVQAATFSRFTHQGQICMSANRIFVQRDVY
ref|NP_693628.1|       EVASRNLKEVHLELGGNSALIVLEDADVDYAVSAGVFSRFTHQGQICMSANRIIVHEDVY
RAAC01575              EVAGRHLKRVTLELGGNSALIVLDDADLDLAVDAAVFSRFTHQGQICMCANRVIAVKDVY
                       ::* :::*.  *****::::  *::  **.*..***********.*::.    ..:* ref|YP_001420375.1|    DKFTELYEAKVSSLKVGDPMDPDTVIGPLINERQAEGLRRSVEKAIEEGAVPVLSGRFSG
ref|NP_388616.1|       DKFLELYQAKVESLKVGDPMDPDTIIGPLINSRQTDGLMKTVEQAIEEGAVPVKLGGFNG
ref|YP_077980.1|       PEFLKLFSQKVSGLKTGDPLDPETVIGPVINERQAEHLRKSIEKGIEEGATPLLKGDIKG
ref|NP_241871.1|       DEFVERYVTKVASLKVGDPRDPETVIGPVMNSRQAETLKQAIESGIAAGAKPVLHGAISG
ref|NP_693628.1|       DEFVQKYADKVKTLTCGDPADSSTIIGPLINERQVQNTVNLIEKGVEEGAHPLVRGQVNG
RAAC01575              ERFLGKFVERVSKLKMGSPRDPETVIGPLINRRQVERLLAVVDASIEQGARVAYRGPVDG
                         .*   :   :*  *.  *.*  *..:*:*  .:         ::  .:         *  ..* ref|YP_001420375.1|    TVAEPVILKDVKPEMSIAKEELFGPAVCIMTFETEDEAVSIANATPFGLSGAVHTANVER
ref|NP_388616.1|       TIVEPTILKDVKPFMSIAKEELFGPVVSFMKFDSEDEAVDIANETPFGLSGAVHTSNLER
ref|YP_077980.1|       NLVEPTILADVTPDMSVAKEELFGPVVCVMPFETEADAVEIANDTPFGLSGAVHTGNVES
ref|NP_241871.1|       NMVEPTILIDASPEMAIAQEELFGPVVCVIPFDTEEEAVEMANDTKYGLSGAIHTANVER
ref|NP_693628.1|       NVVEPVIFTEVTPDMQIANEEFFAPVVAIMKVSSEEQAIAYANASSYGLSGAVHTSDVNR
RAAC01575              NVVGPVVLADVGPEMACAKEEMFGPVVAVMPVEDEEEAVRAANDSEYGLTGAVITRDVER
                       .:. *.::  :. *  *  *:**:*.*.*..::  ..  *  :*:   **  :  :**:**:  *  :::
```

FIG. 47B

```
ref|YP_001420375.1|    GVEFAKRIETGMIHVNDTTINDEPNVAFGGEKQSGLGRLNGEWSLEEFTTLKWISVQHEK
ref|NP_388616.1|       GVAFAKRIETGMIHVNDTTINDEPNVAFGGEKQSGLGRLNGEWSLEEFTTLKWISVQHEK
ref|YP_077980.1|       GVAIAKQIETGMIHVNDTTINDEPHVAFGGEKQSGIGRLNGEWSLDEFTTLKWISVQHQK
ref|NP_241871.1|       GVEIAKRIQTGMIHVNDITINDEPIVAFGGEKHSGLGRLNGEWSLEEFTTLKWVSVHYSQ
ref|NP_693628.1|       GAEVAKQLESGMIHINDGTINDEPNVAFGGVKNSGVGRLNGEWSLEAFTTTKWISIQHTK
RAAC01575              GVRIAMQVETGMFHVNDGTVNDEPLVAFGGEKGSGVGRYNGQWGIDEFTTLKWISIQRER
                       *.  .*  :::.**:*:** *:**** ***** * **:** **:*.:: *** **:*::  :

ref|YP_001420375.1|    RQFP-
ref|NP_388616.1|       RSFP-
ref|YP_077980.1|       RSFP-
ref|NP_241871.1|       RVFP-
ref|NP_693628.1|       RQFP-
RAAC01575              RQYPI
                       *  :*
```

FIG. 48

```
ref|YP_001126012.1|    ------------------------VLNEEGTVVQPEYRERITKELTMVMYRHLIRTRTF
ref|ZP_01860561.1|     MIQSRDRGEEMEEQFPIK------RIIDNDGTLLG-DKDPGITEQLAKEFYRHMVRIRTF
ref|ZP_01171269.1|     ------------------------MIDENGNEVS--GTSGFDTELALEFYRQLVRIRVF
dbj|BAB40585.1|        ----------EHQFPK------IQIVDENGNIVDSKYEDKLTPEFIKELYERLMFVRTF
ref|NP_241079.1|       ------------------------------------------VLSMYKQMINCREF
RAAC01657              MLAEHDRAERLMEIAKAEGLYEEIHLLKEDGTLAG--AVDDIPPEVMVAMYRHMVFARAF
                                                                 :*.::: * * ref|YP_001126012.1|    DRKCVSLQRQGRIGTYVPYEGQEACQVGSALALNDEDWMFPTYRDHGAMMTFGRSLVNTL
ref|ZP_01860561.1|     DKKAISLQRQGRIGTYAPFEGQEASQVGSSAALKEDDWMFPSYRDHGAAMTFGHSLRNIL
ref|ZP_01171269.1|     DRKAVSLQRQGRIGTYAPFEGQEAAQIGSAMALEESDWMFPTYRDHGAALAFGHSMRNVL
dbj|BAB40585.1|        DRKAISLQRQGRLGTYAPFEGQEAAQVGSALALEKDDWLFPTYRDHAATITFGHKLSTVF
ref|NP_241079.1|       DEKALKLQRQGRIGTYASFKGQEACQIGGALALRPTDWLFPTYRDHAAISTHGQPWHRIF
RAAC01657              DRKAIALQRQGRIGTYAPFEGQEAAQVASAMALAPEDFVFPSYRDHAATMVLGQSPANVL
                       *.*.: ******.***...::****.*...:  **   *::**:****.*  . *:   :

ref|YP_001126012.1|    LYWKGRTEGCVPPEGKKIVPPSVPIATQLPHAAGAACAEKWKGTKNAVIVYFGDGATSEG
ref|ZP_01860561.1|     LFWKGRNEGCVPPQGKKIFPPGIPIATQLPHAAGAAYAEMRKGTKNAAIVYFGDGATSEG
ref|ZP_01171269.1|     LFWNGRNEGCIPPEGKNIFPPGIPIATQIPHAAGAAYAEKRKGTKKAAIVYFGDGATSEG
dbj|BAB40585.1|        LYWNGRVEGCVPPEGKKIFPPAVPIATQLPHATGAAMAEKYKGTKNAAIVYFGDGATSEG
ref|NP_241079.1|       LYWMGHMDGSLSPDDRNILPPAVPIATQMLHAVGTAWADKLKGNPHVSLVFFGDGATSEG
RAAC01657              LYWSGRVEGIRSPEGRHILPPSVPIATHVLHAVGAAWASRYRKESAVSIAYFGDGATSEG
                       *:* *: :*  .*:.::*..:*:: .*:*  *.  :    . :.:******** ref|YP_001126012.1|    DFHEGLNFASVFNAPVVFFNQNNQYAISVPITRQMRSKTIAQKALAYDIPGVRIDGNDVF
ref|ZP_01860561.1|     DFHEGLNVASVLNAPVVFFNQNNGFAISVPIKKQMKTKTIAQKALAYDIPGVRIDGNDIF
ref|ZP_01171269.1|     DFHEGLNFASIVKAPVVFFNQNNQYAISVPLSKQMNTKTIAQKSLAYDIPGVRVDGNDVF
dbj|BAB40585.1|        DFHEGLNFASVFKAPVVFFNQNNSFAISVPIHKQMNSKTIAQKSVAYGIPGIRLDGNDIF
ref|NP_241079.1|       DFHEALNFAGVYQTPTIFFCQNNGYAISVPFEKQSASKTIKQRSVAYDMRGERVDGNDIF
RAAC01657              DFHEALNFAGVFHLPVLFFCQNNGYAISVPFSRQSASRTIAQRAIAYDIVGVRVDGNDAF
                       **..*.: : *.: * :*****: :*  ::** *:::**.: * *:**** * ref|YP_001126012.1|    AVYFQTAEALERARHGGGPTLIEAVTWRYGAHTTSDDPSRYRDQEESKKRRET-TDPIKR
ref|ZP_01860561.1|     AVYFETLKALERARNGEGPTLIEAVTWRYGAHTTADDPTKYRDQSESDERRKL-GDPIAR
ref|ZP_01171269.1|     AVYRETKKALERAREGGGPTLIEAVTWRYGAHTTADDPAKYRDQQESSVLRGK-IDPILR
dbj|BAB40585.1|        AVYFYTKEALDRARNGEGPTLIEAVTWRYGAHTTADDPTKYRNQEESLERREK-YDPILR
ref|NP_241079.1|       AVYLTVKRAIEQARKGRGPTLIEAVTTRFGSHTTADDAKKYRDQEEIERTWKEMQDPLTR
RAAC01657              AVYRAVKEARSRALHGLGPTLIEAVTFRMGAHTTADDPTRYRDQKAVVEAWQK-RDPIVR
                       ***   .* .:*  .* ********* * *:*:. :**:*.        **: * ref|YP_001126012.1|    VVRLMQREGWWNEQWANQVQEEVNAEIEQAVAEMERYPKANASDMFDYVFAEPTWTIA--
ref|ZP_01860561.1|     LQRYMERQGWWDQEWADSVQKEYTAEMDQAVEELESYPEADPKVIFDYVFEKPTWTIS--
ref|ZP_01171269.1|     MERWLKNKDLYDENWAKRAESEAAAEIDLAIAEMEAYPPADPADIFDHVFAELIWPL---
dbj|BAB40585.1|        VERLMKNKGIWDEKWAASVEEKASQTIEEAVKEMEAFPAPDVNDLFDHVFEKPTW-----
ref|NP_241079.1|       LKAYIQAKGWLSEEEEAQMKAKIRETIDEELSMAEQYPKPSISQMFEHVYENQPWYV---
RAAC01657              LRLYLESQKLWSESDEAKLQDEVKARVEAAVEEALSIAPPDMEMMFDHVYAEEPWHLAAE
                       :   :: :   .:.      : :    :: :       . ..  :*::*: :  * ref|YP_001126012.1|    --------------
ref|ZP_01860561.1|     -------------
ref|ZP_01171269.1|     -------------
dbj|BAB40585.1|        -------------
ref|NP_241079.1|       -------------
RAAC01657              REEYRRTREGVSV
```

FIG. 49

```
ref|YP_001126011.1|    -TKSLTLVQAVNDALRIMLKERDDVVLLGEDVGRNGGVFRATDGLLQEFGEERVIDTPLS
ref|NP_693798.1|       -TKQLTLIQAITDGMRTMLHEREEVVVLGEDVGKNGGVFRATDGLQEEFGEKRVFDTPLS
dbj|BAB40586.1|        ----LTLVQAVTDGLRTMLKEKKEVIVLGEDVGKNGGVFRATDGLQEEFGEDRVIDTPLS
ref|ZP_00539126.1|     ----MTLVQAVTDALRTKLTDDETTLVLGEDVGKNGGVFRATDGLQEEFGEDRIIDTPLS
ref|NP_241080.1|       -SQQQTMLQAINQTLDDLLATNDDVMLLGEDIGINGGVFRATDGLYEKYGKDRVVDTPLA
RAAC01658              MSRMLNLVQAINEALDLKLADDPRVVLLGEDIGKNGGVFRATDGLLEKYGEERVIDTPLA
                          .::**:.:  :      *        .::****:* **********  :::*:.*:.****:

ref|YP_001126011.1|    EAGFTGAAIGMALNGFRPVVEIQFLGFIYPAYEQIMTHAARMRSRTRGHFTVPLVIRAPY
ref|NP_693798.1|       EAGIIGSSIGMAINGLLPVAEIQFSGFIYPAYEQIMTHATRMRYRTKGVFTVPLVIRAPY
dbj|BAB40586.1|        EAGIVGVSIGMAINGMLPVAEIQFLGFIYPAYEQIMTHASRIRMRTMSKFHVPLVIRAPY
ref|ZP_00539126.1|     EAGIVGTSIGLAVNGFKPIVEIQFLGFIYPAYEQIMTHVSRIRMRTMGRYGVPMVIRAPY
ref|NP_241080.1|       ESGIIGSAIGLAMNGKRPIVEIQFLAFIYPGFEQLISHAARMRYRTRGQYNVPMVIRTPY
RAAC01658              ESAIIGTSIGMAVNGLIPVPEIQFLAFIFPALDQLFSHVARMRYRSQGQFPVPMTIRTPY
                       *:.:  *  :**:*:**  *:  ****  .**:*.  :*:::*.:*:* *:  . :  **:.**:**

ref|YP_001126011.1|    GAGVRAPEIHSDSTEALFTHMPGVKVVCPSSPYDAKGLLIAAIEDPDPVLFLEPMRNYRA
ref|NP_693798.1|       GAGVRAPEIHSDSMEALFTHMPGIKVVCPSSPYDAKGLLISAIEDPDPVLFLEPLKLYRA
dbj|BAB40586.1|        GAGVRAPEIHSDSVETLFTHMPGIKVVCPSTPYDAKGLLIAAIEDPDPVLFMESMKLYRS
ref|ZP_00539126.1|     GAGIRAPEIHSDSTEALFTSMPGLKVVCPSTPYDAKGLLIAAIEDPDPVLFLESMRSYRA
ref|NP_241080.1|       GAGIRGPELHSESVEAFFAHTPGLKVVAPSNPYDAKGLLTAATSDPDPVIFLEDTKLYRA
RAAC01658              GAGIHGPELHAESVESFFAHTPGLKVVVPSGPYDAKGLLISAIEDPDPVVFLEPTKLYRA
                       ***::.**:*::*  *::*:  **:***  ** ********  :*  .*****:*:*    :  **:

ref|YP_001126011.1|    FREDVPEGKYTVDIGKGKKLREGEDVTVIAWGAMVPVAMKAAEAAAK-KGIDADVIDLRT
ref|NP_693798.1|       VRGEVPEEKYEIEIGKGKYLREGDDVTVIAWGAMVPVAMKAAEQ-AAEKGITCEVIDLRT
dbj|BAB40586.1|        SREDVPEGKYTVEIGKARKVRDGKDVSIFAWGAMVPVATKAAEEMEK-KGVTCDVIDLRT
ref|ZP_00539126.1|     FKEPVPSEAYTIEIGKANCITEGQDVTLIAWGAMVQVAQKAATE-AATRGISCEVIDLRT
ref|NP_241080.1|       FKEDVPNTLYEIPLGQQAKVVQEGEDVTVIAWGGMVREALQAAKEAEKAHGWSCEIIDLRT
RAAC01658              FREEVPEGLYRVPIGKAKRVREGEDVSVFAWGSMLHTALKVAEAIERERGWTCDVIDLRT
                         :   **.   *  :  :*:...     :  :*.:::*.*:   *  :..*           :*   .::***** ref|YP_001126011.1|    LYPLDKDMIAESVQKTGRTVIVQEAHATGGLANDILAVINDTSFFYQKAPAERVTGFDVP
ref|NP_693798.1|       LYPIDRAIIAESVQKTGRCVVVHEAPATGGLGNDIISIVNDTSFLYMKSPIERVTGADVH
dbj|BAB40586.1|        LYPLDKDAIAESVQKTGRVVIVHEAHATGGVSNDVMAVINDTAFLYKAPIERVTGFDVP
ref|ZP_00539126.1|     LYPLDRETISASVQKTGRAVIIHEAQATGGLGNDLLALINDTSFLYRAPVARVTGFDVP
ref|NP_241080.1|       IAPIDRETIIESVKKTGRAIIIHEAHKTAGLGGEITALINEEALIYLKAPVKRIAGFDIP
RAAC01658              LYPLDRDAIVESVQKTGRAVVVHEAHKTAGLGAEIVSLINEEALLYRAPIKRIAGFDVP
                       :  *:*:   *   **:****  :::**   *.*:.  ::  :::*:  :::*   ::* *:

ref|YP_001126011.1|    VPFFAHEDDYLPTPARVLHAIEKVM--
ref|NP_693798.1|       VPFWALEEHNIPTPARVMDAINQVINF
dbj|BAB40586.1|        VPFFTLEEHYLPNTGRVVKAIEKVIHF
ref|ZP_00539126.1|     VPLFALEDHYIPTPTRVLEAIQRTVDF
ref|NP_241080.1|       VPQFLSENQYLPTIERMFRGIEETVSF
RAAC01658              VPFFALEDEYMPTEARIRAGIEETITF
                       **  :   *:.  :*.  *:    .*:...:
```

FIG. 50

```
ref|YP_001125402.1|      ----------MPTFQAFVVNKTEAEFTAGVETLSMDDLPEGDVVVRVHYSSVNYKDGLA
ref|YP_147282.1|         ----------MSAFQAFVVNKTETEFTAGVQTISMDDLPEGDVVVRVHYSSVNYKDGLA
ref|ZP_01859257.1|       -------------TFKALVVNKTEEDFSVNIEPLTFEDLPQGDVTIRVHYSSVNYKDGLA
ref|YP_001420249.1|      --------------FKALVVDQREDRFSVSVRELAVQDLPEGEVLIKVCYSGVNYKDSLA
ref|NP_388913.1|         -----------TLFQALQAEKNADDVSVHVKTISTEDLPKDGVLIKVAYSGINYKDGLA
RAAC01669                MRSRPPKEVHDMTTFRAHMVEQDGNAHRAGVRELTLDQLPEGEVLIRVRYSSVNYKDGIC
                                            *:*    .::       . :.  ::  ::**:. * ::* **.:****.:.

ref|YP_001125402.1|      SIPDGKIVKTYPFVPGIDLAGIVVSSNDARFREGDEVIATGYEIGVTHFGGYSEYARLHG
ref|YP_147282.1|         SIPDGKIVKTYPFVPGIDLAGVVVSSQHPRFREGDEVIATGYEIGVTHFGGYSEYARLHG
ref|ZP_01859257.1|       SIPNGKVVQSYPFVPGIDLAGVVTSSDDDRYKEGDKVIVTSYELGVSHYGGYSEYARVPG
ref|YP_001420249.1|      AIPDGKIVTSYPFVPGIDLAGIVVSSDDARFKEGDKVIATSYGIGVSRFGGYSGMARIPA
ref|NP_388913.1|         GKAGGNIVREYPLILGIDAAGTVVSSNDPRFAEGDEVIATSYELGVSRDGGLSEYASVPG
RAAC01669                SQPASRLVTRYPMVLGIDLAGEVVESRDARFRPGDPVICTSYDLGTGHFGGFSEYARVPA
                         .  .  ..:*  **:: *** ** *,..*  . *:  ** **  *.*  :*.  :  ** *  * :  .

ref|YP_001125402.1|      DWLVPLPKGLTLREAMAIGTAGFTAALSIHRLEELGLVPERGPVLVTGATGGVGSLAVSM
ref|YP_147282.1|         DWLVPLPKGLTLKEAMAIGTAGFTAALSIHRLEEHGLTPERGPVLVTGATGGVGSLAVSM
ref|ZP_01859257.1|       DWVVPLPDNLTLKEAMVFGTAGFTAALSIHQLENSGLRPENGPVLVTGATGGVGSMAVAM
ref|YP_001420249.1|      DWIVPLPEGLTLKEAMTIGTAGFTAALSVQRLEENHAAPEKGKVLVTGATGGVGSFAVSI
ref|NP_388913.1|         DWLVPLPQNLSLKEAMVYGTAGFTAALSVHRLEQNGLSPEKGSVLVTGATGGVGGIAVSM
RAAC01669                DWVVPLPDGLSLRDAMVLGTAGFTAALSLYRMEQNGVSPAMGAMLVTGATGGVGATGIAI
                         **:****..*:*::**. **********:  :::*    *   * :***********.  .:::

ref|YP_001125402.1|      LAKRGYTVAASTGKATEHDYLRALGAKEVLTRED---VTAERIRPL--DKQRWAAAVDPV
ref|YP_147282.1|         LSKRGYTVEASTGKTAEHDYLRALGAKEVLTRED---VTAERIRPL--DKQRWAAAVDPV
ref|ZP_01859257.1|       LAKRNYHVTASTGKESEHEYLKSLGAKEIVSREE---VAPEKIRPI--GKQRWAGAVDPV
ref|YP_001420249.1|      LSTLGYEVEASTGKEDESGYLKSLGAKTVIHRDE---VYNGTLKPM--QKQKWAAAVDPV
ref|NP_388913.1|         LNKRGYDVVASTGNREAADYLKQLGASEVISRED---VYDGTLKAL--SKQQWQGAVDPV
RAAC01669                AKRAGYRVVASTRKDEAAEWLKTLGADDVVRPDA--LLLQEGESYLN-VKTRYAGVIDPV
                          .* * ***  :      :*: ***. ::      :            : * ::  ..:*** ref|YP_001125402.1|      GGRTLATVLSRIRYGGAVAVSGLTGGVEVPTTVHPFILRGVSLLGIDSVYCPMDLRLRIW
ref|YP_147282.1|         GGRTLATVLSRIRYGGAVAVSGLTGGAEVPTTVHPFILRGVSLLGIDSVYCPMDVRLRIW
ref|ZP_01859257.1|       GGKTLASVLSNTKYGGAVAVSGLTGGADVPTTVFPFILRGVNLLGIDSVYCPKELRETLW
ref|YP_001420249.1|      GGEPLASVLSQIQYGGSVAVSGLTAGTKLPATVFPFILRGVSLLGIDSVFCPMETRKKTW
ref|NP_388913.1|         GGKQLASLLSKIQYGGSVAVSGLTGGGEVPATVYPFILRGVSLLGIDSVYCPMDVRAAVW
RAAC01669                SGKYVPHLLQRLEYGGVIAISGYTGGPDFTASVFPFLRRQAAIIGIDSVWLDMETRREIW
                          .*. :.  :*.. .*** :*:**  *.* ...::*.**:  * .  ::*****:   : *    * ref|YP_001125402.1|      EQLASDLKPD----LEQIVHEISLHELPGALARILRGELRGRTVVRL
ref|YP_147282.1|         ERLAGDLKPD----LERIAQEISLAELPQALKRILRGELRGRMVVRL
ref|ZP_01859257.1|       NRMADDLKP---DGLGEIENEVTLEELPRTLSAILQGKTRGRTVVKI
ref|YP_001420249.1|      QRLADDFKPADLEAF--IQKEITLEELPDTLPALLKGEARGRTIVTI
ref|NP_388913.1|         ERMSSDLKP--DQLLTIVDREVSLEETPGALKDILQNRIQGRVIVKL
RAAC01669                RRLAGPWKPS-DEALRQIGHDITLDDLDSALKQILAGRMQGRAVVNL
                         .:::. **     :  : .:::*  :   :*  :*  .. :** :* :
```

FIG. 51A

```
ref|ZP_01696606.1|      ----------EEATFSIRINGQELAARKG--QTILEVANAHDMYIPAICYHPNLGSIQTC
ref|ZP_01171726.1|      -------------TYQVKLNGAEVKVAAGDETTILQLLQNSSVEVPNVCYHPSLGPIETC
RAAC01678               MIDIRTEAQAEARTVQLEIDGKEVTVERG--ASVLDAILSTGQEHPHVCYHPALGPIETC
ref|YP_146312.1|        ----------EAQMVTVTINGRAYRAKPG--MTILEVVNEHGLPHPQVCYTPELGAIQTC
ref|YP_001124591.1|     ----------ETRTVTVTINGRPYHVKQG--MTILETVNEHGLPHPQVCYTPELGAIQTC
ref|ZP_01696079.1|      ----------ETKSIHITIDGRDYEARPG--EKIIDVINRNDIFHPQICYYPEVDPIQTC
                                  :  ::*    . *     .:::      .   * :** * :...*:**

ref|ZP_01696606.1|      DTCFVNVNGNLVRACATKVEPGMEVESGSKPVKDAQYEAMSRILKNHELYCTVCDNNNGN
ref|ZP_01171726.1|      DTCIVSVNGELVRSCSTKLNDGDIIDTVSADVKEAQVIGMDRILTNHELYCTVCDYNNGG
RAAC01678               DTCIVEIDGKLMRACSTPVEDGMAVRTKSVAARYARKEAMDRILKNHELYCTVCDNNNGN
ref|YP_146312.1|        DTCIAEVNGTLLRACATPVEDGMVVELGSPRAKAAQKEAMDRLLENHLLYCTVCDNNNGN
ref|YP_001124591.1|     DTCIAEVNGTLLRACSTLVEDGMVVELSSPRAKVVQKEAMDRLLENHLLYCTVCDNNNGN
ref|ZP_01696079.1|      DTCIAEVNGELMRTCSTVAEDGMVVRLSDDRSEAARHEAMDRILANHLLYCTVCDNNNGN
                        ***:...::* *:*:*:*   : *  :     . . .:  .*.*:* ** ****** ***.

ref|ZP_01696606.1|      CVVHNTAEHLEIEHQKYQFEAKPYP--PDQSHPFYRYEPDQCILCGRCVEACQDLQVNET
ref|ZP_01171726.1|      CEVHNTVKEMKINHQSVPFAQKPYP--ADNSHPFYRYDPDQCILCGRCVEACQDVQVTET
RAAC01678               CVLHNTVMQMGVEHQAYPFTPKPYE--VDMSNPFYRYDPQQCILCGRCVEACQNLQVSEV
ref|YP_146312.1|        CKLHNTAEMMQIEHQTYPYRPKVDPSEVDMSHPFYRYDPNQCIACGQCVEACQNLQVNET
ref|YP_001124591.1|     CKLHNTTEMMQIEHQTYPYRPKVDPSEVDMSHPFYRYDPNQCIACGQCVEACQNLQVNET
ref|ZP_01696079.1|      CIVHNTTEKMGIEHQKYPFTPKTDASGVDYSNPFYRYDPNQCIACGRCVEACQNLQVNET
                        * :***.   :  ::**   :  *        * *:*****:*:*** **:******:.**.*.

ref|ZP_01696606.1|      LTIDWDREVPRVIWDNDVPIDESSCVSCGHCVTVCPCNALMEKSMLGEAGYLTGIPQKVL
ref|ZP_01171726.1|      LTIDWEREKPRVIWDNDVPINESSCVSCGHCSTVCPCNAMLEKGMEGEAGYLTGIAKQTL
RAAC01678               LSIAWDREVPRVIWDNDVPINESSCVSCGHCVTVCPTNALMEKSMLGEAGFLTGIEKPTL
ref|YP_146312.1|        LSIDWEAERPRVVWDGGVPINESSCVSCGQCVTVCPCNALMEKSMLGEAGFLTGLDKDVL
ref|YP_001124591.1|     LSIDWEAERPRVVWDGGVPINESSCVSCGHCVTVCPCNALMEKSMLGEAGFMTGLDQDVL
ref|ZP_01696079.1|      LSIDWEAERPRVIWDNGVPINESSCVSCGHCVTVCPCNALMEKSMLGEAGYLTGLEEDLL
                        *:* *: * *:. *:*****:* ** ::**.* **:::   * ref|ZP_01696606.1|      EPMIDLTKEVEPGYKEIFAISEMEAAMRKSRIKRTKTVCTYCGVGCSFEIWTKGRHILKV
ref|ZP_01171726.1|      RPMIEITKNVETGYGSILAISDMEAAMRDERIKKTKTVCTYCGVGCSFDVWTKGREILKV
RAAC01678               DKMIDITKKVEPGYSSIFVVSEIEHEMREARIRKTKTVCTYCGVGCAFDVWTKDRHILKV
ref|YP_146312.1|        NPMIDFVKEVEPNYTSIFAISEIEAAMREQRIKKTKTVCTFCGVGCSFEVWTKGRKILKI
ref|YP_001124591.1|     KPMIDFVKEVEPNYTSIFAISEIEAAMQQRIKKTKTVCTFCGVGCSFEVWTKGRKILKI
ref|ZP_01696079.1|      DPMIDLVKKVEPGYGSIFAISEIEASMREQRTKKTKTVCTFCGVGCTFEVWTKGRKILKI
                        **::.*:**..* .*:.:*::*  **. *  ::*****:*****:*:::***.*.***:

ref|ZP_01696606.1|      EPQEHAPVNGISTCVKGKFGWDFVNSEERLTKPLIRKGEEFVEASWDEALNLIASKLQEI
ref|ZP_01171726.1|      DPQPEAPANGISTCVKGKFGWDFVNSEERLTKPLIREGEFFREAEWDEAISLIARRFTEI
RAAC01678               EPQMEAPVNQISTCVKGKFGWDFVNSPDRLTKPLVRKGDRFVEVSWDEALDVIERRIKEI
ref|YP_146312.1|        QPVSEAPVNAISTCVKGKFGWDFVNSEERLTKPLIRKGDVFVESTWDEALDLVAEKLGAI
ref|YP_001124591.1|     QPVSEAPVNAISTCVKGKFGWDFINSEERLTKPLIRKGDTFVESTWEEALDLVAEKLGAI
ref|ZP_01696079.1|      EPKHEGPVNAISTCIKGKFGWDFVNSDKRLTKPLVRKDGKFVETSWDEALSVVASRLKEI
                        :*    ..*.* **:****.  ..*****:.   *   *:**:.:    :   * ref|ZP_01696606.1|      KKQHGPDALGFIASSKCSNEENYLFQKFARAIIGTNNLDNCSRYCQSPATSGLLRTVGIG
ref|ZP_01171726.1|      KNEHGAQAMSFISSSKCTNEESFLMQKLGRAVIGTNNIDNCSRYCQTPATVGLFRTVGYG
RAAC01678               QAKHGYDAVAFISSSKTTNEENYLMQKLARAVMHTNNIDNCSRYCQSPATEALRRTMGLG
ref|YP_146312.1|        KRQYGGNAIGFISSSKISNEENYLMQKLARQVFETNNVDNCSRYCQSPATDGLFRTVGMG
ref|YP_001124591.1|     KQQYGGNAIGFISSSKISNEENYLMQKLARQVFETNNVDNCSRYCQSPATDGLFRTVGMG
ref|ZP_01696079.1|      HSQYGKDAVGFISSSKVTNEENYLMQKLARQVFETNNVDNCSRYCQSPATDGLLRTVGMG
                        : ::* :*:.**:***  ****.:**:::*   ::  ***:********:*** .* **:* *
```

FIG. 51B

```
ref|ZP_01696606.1|      GDSGTIRDIQQADLVVTVGANPAESHPVLATRIKRAHKLHGQKLMVVDLRENELASRANL
ref|ZP_01171726.1|      GDAGSIRDIQMSDLVLIIGSNTAESHPVLSTRVKRSHKLGGQKLIVADLRKHEMADRADL
RAAC01678               GDTGSIKDLELADLVLIVGANPAEAHPVLSTRLRRAQKKRGQKHIVADVRRNIMATRADL
ref|YP_146312.1|        GDSGTIHDIATAGLVIIIGANPAEGHPVLATRVKRAHKLFGQKLIVADLRRNEMAERADL
ref|YP_001124591.1|     GDSGTIYDIASAGLVIIIGANPAEGHPVIATRVKRAHKLFGQKLIVADLRRNEMAERADL
ref|ZP_01696079.1|      GDSGTIKDIASAGLVIIVGANPAEAHPVLATRIKRAHKLHGQKLIVADMRKNEMAERADL
                        **:*:* *:  :.**: :*:*..*:*:*:*::*  *** :*.*:*.:  :* **:* ref|ZP_01696606.1|      FIHSKPSTDLIWLNAVTKYILDQGWEDKAFLEARVKGLDKFRASLEKYTLAFAEEKTGIS
ref|ZP_01171726.1|      FVQPKAGTDIVWLSAVAKYIIDNGMADEEFLAEKVNGLDEFTKNLEKYTMEYAAEVTGIA
RAAC01678               FIQPRQGTDLVWLSAVTKYIIDQGRHDEAFLRDRVNGFDEYVQSLEKFTLDYASEICGLR
ref|YP_146312.1|        FIRPKQGTDQVWLMAVTKYIIDQGWHDEAFIRERVHFFEEFKQLLEKYTLDYAEQVTGIA
ref|YP_001124591.1|     FIRPKQGTDQVWLMAVTKYIIDQGWHDESFIRERVHFFDEFKQLLEKYTLDYAEQITGIA
ref|ZP_01696079.1|      FIHPNQGTDQVWLMAVTKYIIDQGWHDENFIAEKVNFFDEFKETLEKYTLDYAEKMTGIP
                        *::..  .**  :** **:***:*:*   *: *:  :*:  ::::    ***:*: :* :   *:

ref|ZP_01696606.1|      KENLIKMATMIHEAKSVCILWAMGITQHTCGTDASTAISNLLLVTGNYGRPGTGAYPLRG
ref|ZP_01171726.1|      LEQLIDMAEMIGRAKSVCALWAMGITQHMGGSDASTAISNLLLVTGNYAKPGAGAYPLRG
RAAC01678               KEELVRVAEMIMEAKRVAVCWAMGVTQHRGGSDTSTAICNLLLVTGNVARPGTGAYPLRG
ref|YP_146312.1|        KADLIRIAEMIHEADGTCVLWGMGVTQNTGGSDTSAAISNLLLATGNYGRPGAGAFPLRG
ref|YP_001124591.1|     KTDLIRIAEMIHEADGTCVLWGMGVTQNTGGSDTSAAISNLLLATGNYGRPGAGAFPLRG
ref|ZP_01696079.1|      KETLIQIAEMIHQADGTCILWGMGVTQNTGGSDTSAAISNLLLATGNYTRPGTGAYPLRG
                         *: :* ** .*. ..  *.::  *:*:*:..*  :::**** ref|ZP_01696606.1|      HNNVQGACDFGTMPAWFPGYEPVEDNEVRERYEKAWGVKLPENPGLDNHQMIGGIKSGKL
ref|ZP_01171726.1|      HNNVQGASDFGSMPNMFPGYQEVADPEIRKKYELAWGTELPGEPGLNNHEMVEGIHAGTL
RAAC01678               HNNVQGAGDMGCAPPFLPGYERVDNEEQRRKWEKLWGVELPTTPGLNNHQMVDAIHEGKL
ref|YP_146312.1|        HNNVQGACDMGSLPAWLPGYQHVTDDEARAKFEQAYGVRIDAKPGLDNIQMLEAAERGEL
ref|YP_001124591.1|     HNNVQGACDMGSLPSWLPGYQHVTDDAARTKFEKVYGVRIDAKPGLDNIQMIEAAERGDL
ref|ZP_01696079.1|      HNNVQGACDMGTLPGWLPGYQHVEDDAAREKFEKAYGVKISNKPGLNNIEMLHAIAAGQL
                        *******  *:*     *  :***:  * :    * ::* :*..:   ***:* :*: .   * * ref|ZP_01696606.1|      RGLYLFGEEMAIVDSNINFVEEHLEKLDFFVVQDVFFSKTAQFADVILPAAPSLEKEGTF
ref|ZP_01171726.1|      KAMYLKGEDMGLVDSNINHVHAAFEKLDFFVVQDIFLSKTAEFADVVLPASPSLEKEGTF
RAAC01678               KAMYLCGEDMAVVDSNANYVEDAFRKLEFFVVQDVFLSKTAQFADVVLPACPSLEKEGTF
ref|YP_146312.1|        KAMYIVGEDMALVDCNANHVQETLAKLDFVVVQDIFLSKTAQFADVILPAAPSLEKEGTF
ref|YP_001124591.1|     KAMYIIGEDMALVDCNANHVQDTLAKLDFVVVQDIFLSKTAQFADVILPAAPSLEKEGTF
ref|ZP_01696079.1|      KAMYIIGEDMALVDSDANHVSEELSNLDFLVVQDVFFSKTAYADVILPAAPS*********
                        :..:*:  **:*.:**.*.:  *.*     :  :*:*.****:*:**::*.* .******* ref|ZP_01696606.1|      TNTERRIQRFYQVFEPMGESKPDWVIFQELANKMGAQWHYQHPGEIMAEAASLAKYFAGI
ref|ZP_01171726.1|      TNTERRIQRLYQALEPLGDSKPDWQIIMEIANSLGAGWNYTHPSEIMEEASRLMPLYSGV
RAAC01678               TNTERRIQRLYRVLEPLGDAKPDWEIIQMVANRFGAHWNYTSAREIFEEMASAADLFRGA
ref|YP_146312.1|        TNTERRIQRFYQALEPLGDSKPDWWIIQEIAKRLGADWNYAGPKEIMDEIASLAPLYSQA
ref|YP_001124591.1|     TNTERRIQRFYQALEPLGDSKPDWWIIQEIAKRLGADWNYAGPSEIMDEIASLAPLYSQA
ref|ZP_01696079.1|      TNTERRVQRLYQALPALGESKPDWWIIQEVAKRLGADWNYSHPGEIFAEMASLTPLFAQA
                        ******:**:**:..: .:**:**** *: :*: :** *:*   .  **: *  :         :

ref|ZP_01696606.1|      SYERLEGFNSQIWPVKKDGTSTPLLYQDRFAFPDGKARLVPVDWEPPFSAGEGFDYHLNN
ref|ZP_01171726.1|      TYERLEGYNSLQWPVAEDGQDTPLLYTERFPFEDGRARLVPVDWTKPLEFEEEYDLHINN
RAAC01678               SYDRLEGYGSLQWPVLPDGTDTPLLYTDGFAFPDKKARLYPVDWTPPIEVGEEYDLELNN
ref|YP_146312.1|        HYDRLEGWNSLCWG-SHDGADTPLLYKERFNFPDGKARFALADWVEPVQYPEEYDLLVNN
ref|YP_001124591.1|     HYDRLEGWNSLCWGSY-DGADTPLLYKERFNFPDGKARFALADWVEPVQYPEEYDLLVNN
ref|ZP_01696079.1|      DYDKLEGWNSFLWGSL-DGANTPLLYKDGFPFPDGKARFALTDWVKPAEFPEQYDLHINN
                        *::***:.*   *    **.***** :     * :*:* :**  *  * :*:*  * :* :**
```

FIG. 51C

```
ref|ZP_01696606.1|      GRLLEQFHEGNLTDRSPGIHHKVPEPWLEISPEAASERGIKDGALVRLTSPYGKVKVRAV
ref|ZP_01171726.1|      GRLLEHFHEGNMTYRSKGISEKTPSVFLEVSPELAEERGLESGTLVRLSSPYGNVKVQCH
RAAC01678               GRLLEHFHEGNMTSRVPGIHEKVPETFVEISPELAKERGVQDGALVRLVSPYGSIKVRVA
ref|YP_146312.1|        GRLLEHFHEGNLTYKSKGIEHKFPEVFVEVSPELAKERGIEDGALVRLISPYGRVKVRVL
ref|YP_001124591.1|     GRLLEHFHEGNLTYKSKGIQRKFPDIFVEVSPELAKERGISDGALVRLISPYGRVKVRVL
ref|ZP_01696079.1|      GRMLEQFHEGNLTNKSEGIESKVPGVFVEVSPELAKERNLDTGDLVRVTSPFGSLQLHVL
                        **:**:*****:*  :   **   * *   ::*:***  *.**.:.  * ***:  **:*  ::::

ref|ZP_01696606.1|      VTGRVQGKELYLT-MNARKEDEMVNRLTSSYHDRVTHTPNYKEMGVKMEILEEKGKPPLP
ref|ZP_01171726.1|      ITDRVKGKEVYLP-MNDRGE-AAINLLTSSYADKDTDTPAYKEIRAKMEILKAKGEDPLP
RAAC01678               VTDRVSGKHVYVP-LLSHADEEAVNRLTSSDHDTATYTPAYKEMRVRMEVIQSCGEPPIK
ref|YP_146312.1|        VTDRVRGNELFLP-MHSTANESAINILTGPATDRRTNTPAYKQARVRMEVIERSGKTPLP
ref|YP_001124591.1|     VTDRVRGNELFLP-MHSTANESAINILTGPQTDHRTNTPAYKQARVRMEVLERSGETPLP
ref|ZP_01696079.1|      VTDRVQGKELYLP-MHSTEKESAINFLTGPIYDKRQSTPAFKQTKVKMELIRKGGESPLP
                        :*.** *:.::::. :     .  :* **..  *    ** :*:  .:**::.  *: *:

ref|ZP_01696606.1|      KVNHRYGNRIPQISVRVEEKWKRDDFIPI----------
ref|ZP_01171726.1|      RINHRYGNPQPQIGVQVQKKWARKDYI------------
RAAC01678               RGNFRLGKPNPQPGVNVEQKWARKDYVPLVTDRALVKEG
ref|YP_146312.1|        RTNPRFKKRHPQNGVEVERKWRRSDYVPLTEENKGVTIG
ref|YP_001124591.1|     CTNPRFQKRHPQNGVEVERKWRRRDYVPLTEAEKEVKIG
ref|ZP_01696079.1|      KSNHRDKKRNPTRGVEVERKWQREGYQPL----------
                         * *  :  *   .*.*:.** * .:
```

FIG. 52A

```
ref|YP_001211085.1|    MPSVKIYDTTLRDGAQAEGISFSVEDKIKIALRLDKMGFHYIEGGWPGSNPKDLEFFKKI
ref|YP_001111663.1|    -----MYDTTLRDGTQGEGVSLSAEDKVKIALRLDEMGFQYIEGGWPGSNPKDMEFFQKI
ref|YP_431081.1|       ---ILIYDTTLRDGSQGEGISLSVEDKLKIASRLDRLGVDYIEGGWPWANPKDMEFFLRA
ref|NP_213242.1|       ---VYIYDTTLRDGSQMEGVSFSLEDKIRIAEKLDDFGIHYIEGGWPYANPKDNLFFQKA
RAAC01685              MSYVVYLLDTTLRDGTQGEGVSLTVADKLKIAEKLDDLGVAYIEGGFPGANPKDEEFFRAA
ref|YP_001547204.1|    ---IFLYDTTLRDGTQREGLSLSLADKLKIARELDRFGMHYIEGGWPGSNPKDAAFFAEA
                           :.*******:* **:*:: **::** .** :*. *****:* :****  **

ref|YP_001211085.1|    RHCPLRHARLAAFGSTRKAGAAAENDASVKAIIDSGVQVATIFGKSWDFHVFKALGVTLE
ref|YP_001111663.1|    QQYSLRNAQVTAFGSTCRPGVEPHEDANINCLLEAGAKIATIFGKCWDFHVTKALNTTLE
ref|YP_431081.1|       REVIWRQARLVAFGRTRKPGQAAAEDANLLAIKRAGVKVATIFGKSWDLHVTAALGTTLA
ref|NP_213242.1|       KKMNFKNAKLTAFGSTRRPNKKVSEDPQVESLIKAETPVVTIFGKSWDLHVTDALKTTLE
RAAC01685              KSLHLKHAKLTAFGSTRRPGVRVEDDASVRAVLDASTPVVAIVGKAWDFHVTEALRIDLD
ref|YP_001547204.1|    AKMEWKHAKIAAFGSTRRANSKPETDANLKALLDANTPVVTLVGKSWTLHVTEVLETTLE
                            ::*::.*** *  :..    *..: .:  :  . :.::.**.* :** .*   * ref|YP_001211085.1|    ENLAMIRETVAYLKSRGLEVIYDAEHFFDGCKANPAYALETIRAAAESGASAVVLCDTNG
ref|YP_001111663.1|    ENLRMVRESVAYLKSKGLMVFFDGEHFFDGYKANADYALSVLKAAVQGGAATVILCDTNG
ref|YP_431081.1|       ENLAMIGDSVAFLVDQGLEVIYDAEHFFDGFKANPDYALETLKAAAKAGASWIVLCDTNG
ref|NP_213242.1|       ENLNMIYETVEYLKRYVDEVIFDAEHFFDGYKSNPEYALQVLEAALKGGADWVVLCDTNG
RAAC01685              ENLAMIRDTVQYLKQHGREVIFDAEHFFDGFKRNRAYALATVRAAWEAGVDWVALCDTNG
ref|YP_001547204.1|    ENLAMIRDSVALMKAHGKEVIYDAEHFFDGYRADNDYALATIKAAAEAGADWIVLCDTNG
                       *** *: ::*   :      *::*.****  : :  *  ..:**  :.*.  : ****** ref|YP_001211085.1|    GTLPAEVKELVEKARSVL-GVPVGIHAHNDGELAVANTLAAVQAGAEQVQGTVNGYERC
ref|YP_001111663.1|    GSMPQEIQRAVTHVVEELPGVELGIHAHNDGEMAVANSIMAVQAGVSQVQGTVNGLGERC
ref|YP_431081.1|       GCLPWEIEEAVARVRQEI-QVPVGIHAHNDGDLAVANTLAAVTAGCRQVQGTINGFGERC
ref|NP_213242.1|       GTLPHEIYEITKKVKERFKDANVGIHAHNDSETAVANSLMAVLAGARQVHGTINGIGERT
RAAC01685              GSMPHEIHEMVTQVIQEVP-VQVGIHTHNDCELAVANSLAAVQAGARMVHGTINGIGERC
ref|YP_001547204.1|    GSLPDWISAVVQRVKGKIN-TQLGIHTHNDSELAVANSLAAIVGGCRQVQGTINGYGERC
                       *  :*    :   . :.   .  .:*:*  : ****::  *:  .*  *:: *** ref|YP_001211085.1|    GNANLCSVIPNLTLKCG-IETIP-REKLVHLTDLSHFVSEVANISPNPHQPFVGASAFAH
ref|YP_001111663.1|    GNANLCSIIPNLALKMG-YSTIPA-ENLVYLTELSRYVYELANLNPIANQPFVGESAFAH
ref|YP_431081.1|       GNADLCSVMPNLELKMG-YQCLPP-GQLAFLTEVSRYVSEIANVVPAGNQPFVGYSAFAH
ref|NP_213242.1|       GNANLCSIIPNLQLKLG-FDVIP-QENLKKLTELANFVAEIINMPLPRNMPYVGESAFAH
RAAC01685              GNANLASIIPNLELKLG-YPCLPSRDHLRLLTPVARFVGEVCNLVAHSYQPFVGHSAFAH
ref|YP_001547204.1|    GNANLISIIPNLQLKMGMFCVLP--DQLQRLTELSRTVSEIANLNPDEHAAYVGNSAFAH
                       ***:*  *::*  *    :*   :*    ** ::.  * *: *:     .: *** ref|YP_001211085.1|    KGGVHVSALLKDSRTYEHISPGEVGNRRRVLVSELSGMSNLLYKYKELNLDIERQSPEGK
ref|YP_001111663.1|    KGGIHVSALMKEPGTYEHMNPEAVGNVRRVLMSELAGISNLLYKYKELHL--DKSSPEGR
ref|YP_431081.1|       KGGIHVSAVLKAPDTYEHIRPQQVGNERRVLMSDQAGASNLRCKAEEMGL--ELNPERER
ref|NP_213242.1|       KGGVHASAVLKNAKTYEHINPELVGNKRKITVSDLAGRSNLVHKLKEFGIEIDPKSPELK
RAAC01685              KGGIHVSAIQRDPETYEHIPPELVGNERRVLLSELSGVSNVLAQAQAFGIPTEGRETELR
ref|YP_001547204.1|    KGGIHVAAVAKVEHSYQHIEPVQVGNRKRVVISELSGRGNIKMRAEELGV---ESTGLER
                       ***:*.:*:  :      :*:*: * ***  :::  :* :*  .*:    :  :  :         :

ref|YP_001211085.1|    RILEDIKKLESQGFQFEDAEGSFELLVRKTNHGYRDPFILEALRLLVEIKEN-TPAYSEA
ref|YP_001111663.1|    QVLEKLKNMEHGGYQFEAAEGSLELMLRKAMNGYREPFQLESMRLILEMREE-NPIHSEA
ref|YP_431081.1|       GIIEGIKELERQGYQFEGADASLELFLRKTTGEYRQQFEVEYVKALVEKRAG-QEAISEA
ref|NP_213242.1|       KLIDKIKELEKEGYHFEAAEASLELLIKRHFGLVKDYFDFDAYRVLIAKRRDDSLPTSEA
RAAC01685              RLLERIKQMEHMGYQFEGAEASQELLFRRVLNDFTPPFKVLAVRVDTDVQRQ-GEATSQA
ref|YP_001547204.1|    GVLERVKLLESKGFQFEAAEGSFELLVRRAAADYAAPFKLLDVVTIVEQRRG-VEMQAEA
                        ::: :*  :*  *::**  :*:.* **::.::            *  .              :  ::*
```

FIG. 52B

```
ref|YP_001211085.1|    IIKMRVGDRVVHTAAEGNGPVNALDNALRKALYDFYPCIGSMHLTDYKVRVLEEKDGTGA
ref|YP_001111663.1|    VIKLKVGDQVVHTAAEGNGPVHALDNALRKALETFYPEVAGMRLSDYKVRVLEEKAGTEA
ref|YP_431081.1|       IVKLRVGDQVVHTAAEGNGPVNAMDNALRKALEEVFPAIRHMRLTDYKVRVLDEKDATSA
ref|NP_213242.1|       TVRLSVEGVEEHTASLGNGPISALDRALRKALEEFYPNLKELQLIDYKVRIINESAGTSA
RAAC01685              IIKLEVDGEIVHTVSEGNGPVNALDAVLRKALAPHRPEIRRMHLTDYKVRVLDEKDATAA
ref|YP_001547204.1|    TVKLQIGEEIYHTAASGNGPVNALDQAMRKALLSRYPELAEVHLVDYKVRILDSESATGA
                       ::: :     .: **: *:*  .:****    *  :   ::* *****:::.. .* * ref|YP_001211085.1|    AVRVHIQTGDGKRSWGTVGVSRNIIEASWQALADSISYGL------------
ref|YP_001111663.1|    RVRVLIETGDGKKTWGTVGVSTNIIEASWQALADSMAYGL------------
ref|YP_431081.1|       RVRVLIESRDGSNSWNTVGVSTNIIEASWEALLDSMEYAL------------
ref|NP_213242.1|       KVRVLIESTDGKRKWGTVGVSENVIEASWIALRDSIVYKL------------
RAAC01685              RVRVLIESTDGEHVWRTVGVSENVIAASWEALVDSIQYYLALVVPSQALVEA
ref|YP_001547204.1|    TTRVLIEAAMGDERWTTVGCSENIIEASWQALVDSLELPLVRARSNQPVL--
                       .** *::   *.. * *** * *:* *** ** **:     *
```

FIG. 53

```
ref|ZP_00539127.1|       ----------------RILDDAGQ-VTDTSKTDLLTKDLSLALFTHMNRIRTFDRKAINL
ref|YP_074240.1|         ----------------RILQADGT-LLEP-VPAFLSVDQLKDVYRKMVYLRVFDQRCLNL
ref|YP_001127228.1|      ----------------QILDENGN--GDEAKIAAFSDEWLLDAYRAMRRARVVDERLLRM
ref|YP_149070.1|         FDPDKLP-----VEIVRILDENGN--GDEEKLAAFSDEWLLRAYREMRRARVIDERLLRM
RAAC01745                MDDVQVYRFTGDTKPDQVLNEAGE---MVGELPENAADLALEWYPFMIFCRKFDERAQLL
ref|NP_241079.1|         ----------------QVLTPKGE--CQYEGSEFLDKTFVLSMYKQMINCREFDEKALKL
                                          ::*    *          :    *    *.*.:    :

ref|ZP_00539127.1|       QRQGRLGTYAPFEGQEAAQVGSAYALQ-DKDWVFPTYRDHGATLTFG-ADMVRTFLYWNG
ref|YP_074240.1|         QRQGRMGTFAPFSGQEASQVGSAYLLRPDRDWIFPTYRDHGAMHVMG-VPLVNILRYFMG
ref|YP_001127228.1|      QRQGRIGTYAPFSGQEAAQIGSVLALQ-KDDWIFPSYREVAVCLTHG-MPLEQFFHYVRG
ref|YP_149070.1|         QRQGRIGTYAPFSGQEAAQIGSALALH-KDDWIFPSYREVAVCLMHG-MPLEQFFHYVQG
RAAC01745                QRQGRLGTYAPFRGQEAAQIASFAVLR-PSDWVFPTYRELAGMMYHG-LEPVHALLKSRG
ref|NP_241079.1|         QRQGRIGTYASFKGQEACQIGGALALR-PTDWLFPTYRDHAAISTHG-QPWHRIFLYWMG
                         ***::*.* ****.*:..   *:   ::**:     .    *    . :   * ref|ZP_00539127.1|       RVEGCVATDELHIFPPAVPIATQIPHAVGAAWAEKRKGSTQVAVAYFGDGATSEGDFHEG
ref|YP_074240.1|         DEQGSHAPQGVNAFPISIPIATQLLHAVGAAWAGRIKGEDTVAVGYAGDGGTSPGDFHEA
ref|YP_001127228.1|      RLSGKRMPEELNIFPTQIIIAAQTLHAVGCAWATKLKGESHVSVAYFGDGATSEGDFHEA
ref|YP_149070.1|         RLSGKRMPEGVNIFPTQIIIAAQTLHAVGCAWASKLKGEPHVSVAYFGDGATSEGDFHEA
RAAC01745                HPDAGRMPEEIHMAPPQIAIAAQILHAVGAGWACKLQEKDDIAVAYFGDGATSEGDFHEG
ref|NP_241079.1|         HMDGSLSPDDRNILPPAVPIATQMLHAVGTAWADKLKGNPHVSLVFFGDGATSEGDFHEA
                          ..     .:  :  **:*  ****  .**  :  :  . ::: :   ***.**.*****.

ref|ZP_00539127.1|       MNFASVFQAPVILFNQNNGYAISVPIQKQMHSETIAQKALAYGMPSVRIDGNDVFAVYFT
ref|YP_074240.1|         LNFAAVFNVPVIFFIQNNRYAISTPNSRQFKTPTIAQRALGYDIAGVRVDGQDVLAVLAV
ref|YP_001127228.1|      MNFAAVYNVPVIFFCQNNQYAISVPYAKQTASRTIAQKALAYGMKGVLVDGNDVLAVYET
ref|YP_149070.1|         MNFAAVYNVPVIFFCQNNQYAISVPYRKQTASRTIAQKALAYGMKGVLVDGNDVLAVYET
RAAC01745                MNFASVMRLPVVFFCQNNQYAISVPVHRQMASPTIAQKAIAYGMEGLRVDGNDAFAVYQA
ref|NP_241079.1|         LNFAGVYQTPTIFFCQNNGYAISVPFEKQSASKTIKQRSVAYDMRGERVDGNDIFAVYLT
                         :***.*  . *.::* *** ****.*   :*   : ** *:::.*.:  .  :**:* :**

ref|ZP_00539127.1|       MQKALERARSGGGPTLIEAVTWRFGAHTTADDPSKYRDQ---ER-SRDRVDPLERLEAFM
ref|YP_074240.1|         MHEAIERARSGGGPTLVESVTFRYGPHTTSDDPKRYRSQEELEE-W-QARDPIERLRLYL
ref|YP_001127228.1|      MKQAVEAARRGEGPMLIEALTYRLGPHTTADDPTKYRHPEEVET-W-RRKDPLHRLRVLL
ref|YP_149070.1|         MKQAVEAARRGEGPMLIEALTYRLGPHTTADDPTKYRRPEEVET-W-RAKDPLRRLRLLL
RAAC01745                MCYAVERARRGDGPTLIEAVTYRLGPHTTADDPGRYRDAVDVER-WAAAKDPLVRLRLWL
ref|NP_241079.1|         VKRAIEQARKGRGPTLIEAVTTRFGSHTTADDAKKYRDQEEIERTWKEMQDPLTRLKAYI
                         :   *:* **  **  * **  *:*:::   * *.***:**. :**       **:.**.   :

ref|ZP_00539127.1|       KEQGFYDEQEIETIRSRHQEEVEAAVKTMESFPPPDVNDLFDHTFATLPDDL--------
ref|YP_074240.1|         VSQGQWSDSDDEALWTAAREQVAAAVAEAEAMPRPSVDDLFDYLYAEPTPNLVRQKEYLK
ref|YP_001127228.1|      ERRGLWTDAKEEEFVAKVNEEVTAAYEAAVASESGSIADVFDYVYSEAPKLLA-------
ref|YP_149070.1|         ERRGLWTEAQEDALVAQVNDEVTAAYEAAIASKSGSIVDAFDCVYSEAPKLLA-------
RAAC01745                TRQGLWDDERQAACEEEAEARVRQAVADMEAYPHKSLEEAARHVYAEVPEALALHLAKRG
ref|NP_241079.1|         QAKGWLSEEEEAQMKAKIRETIDEELSMAEQYPKPSISQMFEHVYENQP-----------
                          :*    :       . :           .: :      :   .

ref|ZP_00539127.1|       -----------
ref|YP_074240.1|         AYLAKKEGGAR
ref|YP_001127228.1|      -----------
ref|YP_149070.1|         -----------
RAAC01745                KEAR-------
ref|NP_241079.1|         -----------
```

FIG. 54

```
ref|ZP_00539126.1|        ----TLVQAVTDALRTKLTDDETTLVLGEDVGKNGGVFRATDGLQEEFGEDRIIDTPLSE
RAAC01746                 MPKWTMIEAIRDALAIALRDDPRVLVFGEDVGKNGGVFRATDGLQAEFGEARVADTPLAE
ref|YP_149069.1|          MAELTMIEAINEAMRQEMERDPRIIVLGEDVGENGGVFRATDGLLAQFGEGRVFDTPLAE
ref|YP_001127227.1|       MAELTMIEAINEAMRQEMERNSRVIVLGEDVGENGGVFRATDGLLEQFGSGRVFDTPLAE
ref|YP_001125046.1|       MAQMTMVQAITDALRIELKNDPNVLIFGEDVGVNGGVFRATEGLQAEFGEERVFDTPLAE
ref|NP_833691.1|          MAQMTMIQAITDALRVEMKNDPNVLVFGEDVGVNGGVFRATEGLQAEFGEDRVMDTPLAE
                              *:::*: :*:     :   :   :::*** ****:  :**. *: ****:* ref|ZP_00539126.1|        AGIVGTSIGLAVNGFKPIVEIQFLGFIYPAYEQIMTHVSRIRMRTMGRYGVPMVIRAPYG
RAAC01746                 KAIVGTAVGLAMAGMKPVAEIQFLGFAYEAMDQIAAQLARIRFRTQGRFTAPAVIRAPYG
ref|YP_149069.1|          SGIIGTSIGLAINGMRPIAEIQFLGFVYQAMDQLAAQAARIRFRSAGRFSCPIVVRSPYG
ref|YP_001127227.1|       SGIIGTSIGLAINGMRPIAEIQFLGFVYQAMDQLAAQAARIRFRSGGRFSCPIVVRSPYG
ref|YP_001125046.1|       SGIGGLAVGLALQGFRPVPEIQFFGFVYEVMDSISGQMARIRYRTGGRYHMPITVRSPFG
ref|NP_833691.1|          SGIGGLAVGLALEGFRPVPEIQFFGFVYEVMDSISGQLARMRYRSGGRWTAPVTVRSPFG
                           .* * ::***: *::*: **:  *  . :.:   : :*:* *: **:  * .:*:*:* ref|ZP_00539126.1|        AGIRAPEIHSDSTEALFTSMPGLKVVCPSTPYDAKGLLIAAIEDPDPVLFLESMRSYRAF
RAAC01746                 GGVRTPELHSDSLEALFAHTPGLVVVTPSRPYDAKGLLLSAIRSPDVVFLEPIRLYRAF
ref|YP_149069.1|          GGVRTPELHSDALEALFTHSPGLKVVMPSNPYDAKGLLISAIRDEDPVLFLEPMKLYRAF
ref|YP_001127227.1|       GGVRTPELHSDALEALFTHSPGLKVVMPSNPYDAKGLLISAIRDDDPVLFFEPMKLYRAF
ref|YP_001125046.1|       GGVHTPELHSDSLEGLVAQQPGLKVVIPSTPYDAKGLLISAIRDNDPVIFLEHLKLYRSF
ref|NP_833691.1|          GGVHTPELHADSLEGLVAQQPGLKVVIPSTPYDAKGLLISAIRDNDPVIYLEHMKLYRSF
                          .*:::**:*:*: *.*.:  *   ****::.. ***:::* :: **:* ref|ZP_00539126.1|        KEPVPSEAYTIEIGKANCITEGQDVTLIAWGAMVQVAQKAATEAATRGISCEVIDLRTLY
RAAC01746                 REEVPEGDYQVPLGRAAVRREGSDVTLVAWGPTVPVAESAAAQVASRGISCEVLDLRTLA
ref|YP_149069.1|          RMEVPEEPYTIPLGQARVVKEGDDVTIIAWGATVPLAAKVAAEMQAKGVNAEVIDLRCLQ
ref|YP_001127227.1|       RMEVPEEPYTIPLGQARIVKEGDDVTILTWGATVPLVAKLADEMRMRGVDAEVIDLRCLQ
ref|YP_001125046.1|       RQEVPEGEYTIPIGKADIKREGKDITIIAYGAMVHESLKAAAELEKEGISAEVVDLRTVQ
ref|NP_833691.1|          RQEVPEGDYTIDLGKADIKREGTDVSVIAYGAMVHAALKAAEELEKEGISLEVVDLRTVQ
                          :   **.  * : :*:*     **  *:::::*. *   . * . .*:. **:*** :

ref|ZP_00539126.1|        PLDRETISASVQKTGRAVIIHEAQATGGLGNDLLALINDTSFLYLRAPVARVTGFDVPVP
RAAC01746                 PLDRSALKASVEKTGRAVIVHEAVRYAGLGAEIAASIMDLAFYHLRAPIERVAGLDTPYP
ref|YP_149069.1|          PLDIDTIITSVEKTGRVMIVHEAVKTGGFGAEVAALISERALFSLSAPIVRIAGYDTPYP
ref|YP_001127227.1|       PLDIDTIIASVEKTGRVMIVHEAVKTSGFGAEVAALISERALFSLSAPIVRIAGYDTPYP
ref|YP_001125046.1|       PLDIETIIGSVEKTGRAIVVQEAQRQAGIAANVVAEINERAILSLEAPVLRVAAPDTVYP
ref|NP_833691.1|          PLDIETIIASVEKTGRVVVVQEAQKQAGIAANVVAEINDRAILNLEAPVVRVAAADTVFP
                          *  .:: :**.:::::  .*:.. ::  *  : :: * **: *::. *. * ref|ZP_00539126.1|        LFALEDHYIPTPTRVLEAIQRTVD-
RAAC01746                 PPALEDAWLPSVTRVVEAIERVMED
ref|YP_149069.1|          VPSVEDDWLPNAERIAEGIETLL--
ref|YP_001127227.1|       VPSVEDDWLPNPARIVEGIETLM--
ref|YP_001125046.1|       FAQAESVWLPNFKDVIETAKKVM--
ref|NP_833691.1|          FSQAESVWLPNHKDIVEAVNKVM--
                          *. ::*. : * : :
```

FIG. 55

```
emb|CAJ88521.1|       ----------QYEIYLNGMTGAVPRLPTDLTRLEELAERR--LGPGPVGYVAGSAGDGSA
ref|NP_625066.1|      ----------QYEIYLNGMTGAVPRLPTDLTRLEELTERR--LGPGPFGYVAGSAGDGST
ref|NP_828658.1|      ----------QYEIYLNGMTGAVPRLPTDLTRLEELTEQR--LGPGPVGYVAGGAGNGST
ref|YP_001104836.1|   -------------------------------SMEE---HARAVLPANAYGYVAGNAGVGAT
RAAC01748             MKRMNIGNEAQFQIYQMRLTGQYGGDPLCISMEDWVARAREVLSPEAFWYLAGGSGRGET
ref|YP_658557.1|      -------------------------------VSFSDLREEAFEEMSWKAKAYVHGGAGTEET
                                                     :  :   .   :  . *: *.:*   :

emb|CAJ88521.1|       ARANRAALDRRRIVPRMLRDVHRRDLSVEVLGRPLPAPLALAPVGVLSIMHPDAEPAAAR
ref|NP_625066.1|      ARANRAALARRRIVPRMLRDVHERDLRVEVLGRSLPAPLALAPVGVLSIMHPEAEPAAAR
ref|NP_828658.1|      ARANRSALDRRRIVPRMLRDVHERDLSVEVLGRTLPAPLALAPVGVLSIMHPDAESAAAR
ref|YP_001104836.1|   GRANRQAFDQWRLVPRMLRGATRRDLTVSLFGQRLAAPVLLAPIAAQTVVHPEGELAAVR
RAAC01748             MRANEEAFAKWRIVPRVFRDVSVRDLSIELFGERLPYPVLLAPIGVQSILHADGEVAAVR
ref|YP_658557.1|      FERNKD-FSRWRIIPRMLRGVADRDLSTTVLGNEHSYPLMITPLGVQSLLHDDGEIATAR
                        . *.   : :  *::**::*..  ***   ::*.  . *: ::*:.. :::* :.* *:.* emb|CAJ88521.1|       AAAAQGVPYILSSASSTPMEQVAEAMGDAERWFQLYWPKDREVARSFLERARAAGYSALF
ref|NP_625066.1|      AAAAQGVPYILSSASSTPMEEVAEAMGDAERWFQLYWPKDREVARSFLDRARAAGYTALF
ref|NP_828658.1|      AAAAQGVPYILSSASSTPMERVAEAMGDAERWFQLYWAKDREVTRSFLNRAKAAGYTALF
ref|YP_001104836.1|   GAADAGVPFVLSTGASHPLEDVAAAAGGQPRWFQLYWPAHRAVCESLVRRAEASGYSALV
RAAC01748             GAAKVGLPYIVSSASTMPLETIAEKAPGATLWFQLYWSRDRDVAQSFVRRAEAAGCKALV
ref|YP_658557.1|      ACAEMDVPFVLSSLSSATMEDVAEALGDTPKWFQYYWASDRDVATSFLDRAETAGYDAIV
                       ..*  .:*:::*:  :: ..:* :*    .   *** **. .* *  *:: **.::*  *:.

emb|CAJ88521.1|       VTLDTPLLSWRPRDLDQAYLPFLHGVGTANYFSDPAFRAGLAKPVHEDPNAAVMHFVGMF
ref|NP_625066.1|      VTLDTPLLSWRPRDLDQAYLPFLHGVGTANYFSDPAFRAGLAKPVHEDPNAAVMHFVGMF
ref|NP_828658.1|      VTLDTPLLAWRPRDLDQAYLPFLHGVGTANYFTDPAFRAGLAKPVHEDPNAAVMHFVSMF
ref|YP_001104836.1|   LTVDSPSFGYRPADLDNGYLPFLNGAGIANFVSDPEFQGGL--PSDAGEREVVEHWARVF
RAAC01748             VTLDTPMMAWRERDLERAYLPFLLGEGLGNYLSDPAFRAKLRRPPEEDPASAILLWTQIF
ref|YP_658557.1|      VTVDAPTLGWRDRLLEKGYYPFLEGEGIGNYFSDPAFRDSLARPPEEDPEAAVDRFLSIF
                       :*:*:*  :.:*   *:..* *** * *  .*:..** *:  *   *  .  . .:  :* emb|CAJ88521.1|       SDPAKTWPDLAFLRENWDGPIVLKGVLHPDDARMAADAGMDGVVVSNHGGRQVAGSVAAA
ref|NP_625066.1|      SDPAKSWPDLAFLRENWDGPIVLKGVLHPDDARLAADAGMDGVVVSNHGGRQVAGSVAAA
ref|NP_828658.1|      ADPGKTWPDLEFLRENWDGPIVLKGILHPDDARRAASAGMDGVVVSNHGGRQVAGSVAAA
ref|YP_001104836.1|   ANPGLTWDDLPWLRSLTGLPIVIKGVLHADDARRAVELGADGLVVSNHGGRQLDGSVASL
RAAC01748             GHPGLTCDDLDWLRETTDLPLLLKGILHPDDAEEAFRRGADGIIVSNHGGRQVDGAVPSL
ref|YP_658557.1|      GDASLTWDDLAFVREQTDLPIIIKGVLHPDDARRAVEAGADAVQVSTHGGRQVDGSIAAI
                       ....  :   ** ::*.    . *:::**:**.***. *   *  *.:  **.***** :*::.:

emb|CAJ88521.1|       DALPRVVEAAGDRLTVLFDSGVRTGDDVFKALALGARAVLLGRPYAYGLGLDGQAGVEHV
ref|NP_625066.1|      DALPRVAEAVGDRLTVLFDSGVRTGDDVFKALALGARAVLLGRPYVYGLGLDGRPGVEHV
ref|NP_828658.1|      DALPRVVEAAGDRLTVLFDSGIRTGDDIFKALALGARAVLVGRPYAYGLGLDGQAGVEHV
ref|YP_001104836.1|   DALPAVRAAVGDGVPVLLDSGVRTGSDVVKALALGADAVLYGRPYVYGLALDGQEGVSHV
RAAC01748             DALVAIRERVGREKVVLMDGGVRRGSDVVKALALGANAVLVGRLYAYGLAVDGERGVETV
ref|YP_658557.1|      EALPEIAEAVGDETTVLFDSGIRRGAQAFKALALGADTVLLGRPFAYGLAHSGQEGVEQV
                       :**  :    .*   **:*.:* *  : **** :    **.  *. **. * emb|CAJ88521.1|       IRCLLAELDLTLALSGHSSPAT---------
ref|NP_625066.1|      IRCLLAELDLTLALSGHASPAT---------
ref|NP_828658.1|      VRCLLAEFDLTLALSGHAGPGTL--------
ref|YP_001104836.1|   LRCLLAELDLALALTGSGAVSEITADLLA--
RAAC01748             LRYLLADFDLTMALSGHRSLSTLDVRALARA
ref|YP_658557.1|      LENTLSQIDLTMGLAGIDDVDDIDRSAV---
                       :.  *:::**:.*:.*
```

FIG. 56A

```
sp|P41009|ATPB_BACCA      MTRGRVIQVMGPVVDVKFENGHLPAIYNALKIQHKARNENEVDIDLTLEVALHLGDDTVR
prf||1211283A             MTRGRVIQVMGPVVDVKFENGHLPAIYNALKIQHKARNENEVDIDLTLEVALHLGDDTVR
sp|Q9LA80|ATPB_GEOTH      MTRGRVIQVMGPVVDVKFENGHLPAIYNALKIQHKARNENEVDIDLTLEVALHLGDDTVR
ref|YP_149211.1|          MTRGRVIQVMGPVVDVKFENGHLPAIYNALKIQHKARNENEVDIDLTLEVALHLGDDTVR
pdb|2QE7|D                MNKGRIIQVMGPVVDIQFESGQLPDIYNAITIE---RPQGGT---LTVEAAVHLGDNVVR
RAAC00450                 MNKGYVVQVMGPVVDVRFPEGQLPAINNALRID----YEGDLPVHLTLEVALHLGDNVVR
                          *.:* ::*********:* .*:** * **: *:    :.    **:*.*:****:.**

sp|P41009|ATPB_BACCA      TIAMASTDGLIRGMEVIDTGAPISVPVGEVTLGRVFNVLGEPIDLEGDIPADARRDPIHR
prf||1211283A             TIAMASTDGLIRGMEVIDTGAPISVPVGEVTLGRVFNVLGEPIDLEGDIPADARRDPIHR
sp|Q9LA80|ATPB_GEOTH      TIAMASTDGLIRGMEVIDTGAPISVPVGQVTLGRVFNVLGEPIDLEGDIPADARRDPIHR
ref|YP_149211.1|          TIAMASTDGLIRGMEVIDTGAPISVPVGEVTLGRVFNVLGEPIDLEGDIPADARRDPIHR
pdb|2QE7|D                CVAMASTDGLVRGLEAVDTGAPISVPVGKATLGRVFNVLGEPIDEQGEVNAEER-HPIHR
RAAC00450                 TIAMSSTDGLVRGVEVVDTGQPISMPVGPGTLGRIFNVLGETIDERGPVDAPER-WPIHR
                          :*:****::*.:* *:* :**. .* : * * **** sp|P41009|ATPB_BACCA      PAPKFEELATEVEILETGIKVVDLLAPYIKGGKIGLFGGAGVGKTVLIQELIHNIAQEHG
prf||1211283A             PAPKFEELATEVEILETGIKVVDLLAPYIKGGKIGLFGGAGDGKTVLIQELIHNIAQEHG
sp|Q9LA80|ATPB_GEOTH      PAPKFEELATEVEILETGIKVVDLLAPYIKGGKIGLFGGAGVGKTVLIQELIHNIAQEHG
ref|YP_149211.1|          PAPKFEELATEVEILETGIKVVDLLAPYIKGGKIGLFGGAGVGKTVLIQELIHNIAQEHG
pdb|2QE7|D                PAPEFEELSTADEILETGIKVIDLLAPYAKGGKIGLFGGAGVGKTVLIQELINNVAQEHG
RAAC00450                 PAPAFGDLTTKTEIFETGIKVVDLLAPYVKGGKVGLFGGAGVGKTVLIQELIHNIAKEHG
                          *** * .:*:*  :*:*.:****.******:*:*:*** sp|P41009|ATPB_BACCA      GISVFAGVGERTREGNDLYHEMKDSGVISKTAMVFGQMNEPPGARMRVALTGLTMAEYFR
prf||1211283A             GISVFAGVGERTREGNDLYHEMKDSGVISKTAMVFGQMNEPPGARMRVALTGLTMAEYFR
sp|Q9LA80|ATPB_GEOTH      GISVFAGVGERTREGNDLYHEMKDSGVISKTAMVFGQMNEPPGARMRVALTGLTMAEYFR
ref|YP_149211.1|          GISVFAGVGERTREGNDLYHEMKDSGVISKTAMVFGQMNEPPGARMRVALTGLTMAEYFR
pdb|2QE7|D                GLSVFAGVGERTREGNDLYHEMKDSGVISKTSMVFGQMNEPPGARLRVALTGLTMAEYFR
RAAC00450                 GYSVFAGVGERTREGNDLYHEMKESGVLDKTCMVFGQMNEPPGARLRVALSGLTLAEYFR
                          * ******************:*:  *********::*:***** sp|P41009|ATPB_BACCA      DEQGQDVLLFIDNIFRFTQAGSEVSALLGRMPSAVGYQPTLATEMGQLQERITSTAKGST
prf||1211283A             DEQGQDVLLFIDNIFRFTQAGSEVSALLGRMPSAIGYQPTLATEMGQLQERITSTAKGSI
sp|Q9LA80|ATPB_GEOTH      DEQGQDVLLFIDNIFRFTQAGSEVSALLGRMPSAVGYQPTLATEMGQLQERITSTAKGSI
ref|YP_149211.1|          DEQGQDVLLFIDNIFRFTQAGSEVSALLGRMPSAVGYQPTLATEMGQLQERITSTAKGSI
pdb|2QE7|D                DREGQDVLLFIDNIFRFTQAGSEVSALLGRMPSAVGYQPTLATEMGQLQERITSTKKGSI
RAAC00450                 DVEQRDVLFFIDNIFRFTQAGSEVSALLGRMPSAVGYQPTLATEMGQLQERIASTVRGSI
                          * : :***:******************************:**********.*** :**

sp|P41009|ATPB_BACCA      TSIQAIYVPADDYTDPAPATTFSHLDATTNLERNVAEMGIYPAVDPLASTSRALAPEIVG
prf||1211283A             TSIQAIYVPADDYTDPAPATTFSHLDATTNLERKLAEMGIYPAVDPLVSTSRALAPEIVG
sp|Q9LA80|ATPB_GEOTH      TSIQAIYVPADDYTDPAPATTFSHLDATTNLERKLAEMGIYPAVDPLASTSRALAPEIVG
ref|YP_149211.1|          TSIQAIYVPADDYTDPAPATTFSHLDATTNLERKLAEMGIYPAVDPLASTSRALAPEIVG
pdb|2QE7|D                TSIQAIYVPADDYTDPAPATTFAHLDATTNLERKLAEMGIYPAVDPLASTSRILSPAVVG
RAAC00450                 TSIQAVYVPADDYTDPAPANTFTHLDATTVLERRIADMGLYPAVDPLASTSRALQPDIVG
                          *****:*************.**:******:**: *:**:*******:***:* *  :**

sp|P41009|ATPB_BACCA      EEHYQVARKVQQTLQRYKELQDIIAILGMDELSDEDKLVVHRARRIQFFLSQNFHVAEQF
prf||1211283A             EEHYQVARKVQQTLERYKELQDIIAILGMDELSDEDKLVVHRARRIQFFLSQNFHVAEQF
sp|Q9LA80|ATPB_GEOTH      EEHYQVARKVQQTLQRYKELQDIIAILGMDELSDEDKLVVHRARRIQFFLSQNFHVAEQF
ref|YP_149211.1|          EEHYRVARVARGVQQTLQRYKELQDIIAILGMDELSDEDKLIVARARKIQRFLSQPFHVAEQF
pdb|2QE7|D                EEHYRVARVARGVQQTLQRYNDLQDIIAILGMDELSDEDKLIVARARKIQRFLSQPFHVAEQF
RAAC00450                 EEHYQVARGVQQAVLQRYRELQDIIAILGMDELTDEDRLIVSRARKIQNFLSQPFFVAEVF
                          ****:*** ** .*:**::*:***********:***:*:*:*** **.:** *:***.*
```

FIG. 56B

```
sp|P41009|ATPB_BACCA     TGQPGSYVPVKETVRGFKEILEGKYDHLPEDRFRLVGRIEEVVEKAKAMG--
prf||1211283A            TGQPGSYVPVKETVRGFKEILEGKYDHLPEDRFRLVGRIEEVVEKAKAMG--
sp|Q9LA80|ATPB_GEOTH     TGQPGSYVPVKETVRGFKEILEGKYDHLPEDRFRLVGRIEDVVEKAKAMG--
ref|YP_149211.1|         TGQPGSYVPVKETVRGFKEILEGKYDHLPEDAFRLVGRIEEVVEKAKAMG--
pdb|2QE7|D               TGMPGKYVPVKETVRGFKEILEGKHDNLPEEAFYMVGTIDEAVEKAKK----
RAAC00450                TGTPGKYVPVKDTVRSFKEILEGKHDDIPETYFRYCGAIEDVIEKARKDGYA
                         ** **.*****:***.********:*.:**   *   * *::..:***:
```

FIG. 57A

```
ref|YP_001125323.1|    ---DVFNARSSFEVNGKKYNYYRLQALEEAGIGRVSRLPYSIKVLLESVLRQVDGRVITK
ref|YP_147200.2|       ---DVFNTRSSFEVNGKKYNYYRLQALEEAGIGQVSRLPYSIKVLLESVLRQVDGRVITK
ref|YP_091630.1|       -----FQSRKTFTVQGKTYSYYSLKALEDQGIGNVSKLPYSIKVLLESVLRQVDGRVITE
ref|ZP_02170376.1|     ----LYQAKKQFEVNGKTYHYYDLKAIEEAGIGNVSKLPYSIRVLLESVLRQHDGRVIKQ
RAAC01759              MGANLFQAKQTLTVGGKSYTYYRLDALQEQGVADISRLPISIKILLESVLRQYDGRVITE
ref|YP_001546865.1|    -----FGAKATLTVGDRSLVYYRLNKLEEDGIAAVSKLPFSIKVLLEAMLRNNDGFAVTK
                            :  ::   :  * .:.   ** *. :::  *:. :*:** **::***::**: **  .::

ref|YP_001125323.1|    EHVENLAKWGTPEMKDIDVPFKPSRVILQDFTGVPAVVDLASMRKAMADLGGDPYEINPE
ref|YP_147200.2|       EHVENLAKWGTPEMKDIDVPFKPSRVILQDFTGVPVVVDLASMRKAMADLGGDPYEINPE
ref|YP_091630.1|       EHVENLAKWGTAELKDIDVPFKPSRVILQDFTGVPAVVDLASLRKAMASVGGDPDKINPE
ref|ZP_02170376.1|     EHVDNLAKFGSGELAAIDVPFKPARVILQDFTGVPAVVDLASLRKAMADFGGDPKEINPA
RAAC01759              EHVRELANWNAANPAKSEVPFKPARILLQDFTGVPVVVDLAAMRTAMHKLGGNPKRINPL
ref|YP_001546865.1|    QDVENMARWNAANPEKIEVPFKPARVILQDFTGVPAVVDLAAMRAAMAQQGGDPQRINPL
                       :.*  ::*.:.: :       :*****:*::***** **.:*   . :*  .*** ref|YP_001125323.1|    IPVDLVIDHSVQVDRYGSDDALEYNMDLEFQRNAERYKFLKWAQKAFDNYRAVPPATGIV
ref|YP_147200.2|       IPVDLVIDHSVQVDRYGSDDALEYNMDLEFKRNAERYKFLKWAQKAFDNYRAVPPATGIV
ref|YP_091630.1|       IPVDLVIDHSVQVDKAGTEDALTVNMDLEFQRNAERYKFLKWAKKAFNNYQAVPPATGIV
ref|ZP_02170376.1|     IPVDLVVDHSLQVDKFGAADSLMFNMEREFERNLERYKFLNWAQKSLDNYRAVPPATGIV
RAAC01759              IPVDLVIDHSVQVDAFGSKEALEFNIAKEFERNEERYRFLRWAQTAFDNFRAVPPGMGIV
ref|YP_001546865.1|    VPVDLVIDHSVQIDQFGSKMALFFNAEREFERNAERYEFLKWGQQAFDNFSVVPPETGIV
                       :***:*:*:*  *:   :*  *   : *. *.: :::*: .* * ref|YP_001125323.1|    HQVNLEYLASVVHAVEGENGEYEAFPDTLVGTDSHTTMINGIGVLGWGVGGIEAEAGMLG
ref|YP_147200.2|       HQVNLEYLASVVHAVEGENGEYEAFPDTLVGTDSHTTMINGLGVLGWGVGGIEAEAGMLG
ref|YP_091630.1|       HQVNLEYLANVVHAVE-EDGEIVTYPDTLVGTDSHTTMINGIGVLGWGVGGIEAEAGMLG
ref|ZP_02170376.1|     HQVNLEYLANVVQEEE-QDGELVAFPDSLVGTDSHTTMINGLGVLGWGVGGIEAEAGMLK
RAAC01759              HQVNLEYLARVVQERT-VDGEQVVFPDSLVGTDSHTTMINGVGVLGWGVGGIEAEACMLG
ref|YP_001546865.1|    HQVNLEYLAKVVQVFT-EEGELVALPDSLVGTDSHTTMINGLGVVGWGVGGIEAEAVMLG
                       ******  :      :  . :************::********* ref|YP_001125323.1|    QPSYFPVPEVVGVRLTGKLPDGSTATDLALKVTQVLRKKGVVGKFVEFFGPGVATLPLAD
ref|YP_147200.2|       QPSYFPVPEVIGVRLTGKLPDGATATDLALKVTQVLRKKGVVGKFVEFFGPGVATLPLAD
ref|YP_091630.1|       QPSYFPVPEVIGAKLVGKLPNGTATATDLALKVTQVLREKGVVGKFVEFFGPGVAELPLAD
ref|ZP_02170376.1|     QPSYFPVPEVVGLKFTGKMPEGATATDLALKVTQILRQANVVGKFVEFFGPGLSDMTLAD
RAAC01759              QPLYFVQPEVIGFKLTGKLPEGATATDLALTVVNMLRKKGVVGKFVEFYGAGLSNISVAD
ref|YP_001546865.1|    QPIYMLLPEVIGFKVTGQLPEGATATDLALTVTELLRKKGVVGKFVEFYGPGVANMALSD
                       ** *: ***:* ..:*:*:*:*******.*.::: .*******:.*::: ..::* ref|YP_001125323.1|    RATIANMAPEYGATCGFFPVDAEALDYLRLTGRDEHHIQVVEAYCKANGLFYTPDAPEPT
ref|YP_147200.2|       RATIANMAPEYGATCGFFPVDAEALDYLRLTGRDEHHVQVVEAYCKANGLFYTPDAPEPV
ref|YP_091630.1|       RATIANMAPEYGATCGFFPVDEEALEYMRLTGRDEEHINVVKEYCRQNGLFYTPDQEDPV
ref|ZP_02170376.1|     RATISNMAPEYGATCGFFPVDEETLNYMRFTGRSEELVKLVETYTKANDMYYTPDKEDPE
RAAC01759              RATIANMAPEYGATMGFFPIDQATLDYLRLTGRDESLIQLVEAYAKAQGMFRTDDMPDPV
ref|YP_001546865.1|    RATIANMAPEYGATMGFFPVDQETIHFLRSTGRSDELADLVEAYSKAQGLFLDANSPEAE
                       ****:********  ****:*  ::..:* ***.:   ..:* *  :.::  : ..

ref|YP_001125323.1|    FTDVVEINLSEIETNLSGPKRPQDLIPLSKMKQSFREAVKAPQGNQGFGLTEADLEREIT
ref|YP_147200.2|       FTDVVEINLSEIETNLSGPKRPQDLIPLSKMKQSFRDAVKAPQGNQGFGLTEADLEREIT
ref|YP_091630.1|       FTDIVEIDLSKVEANLSGPKRPQDLIPLTDMKETFHKHLASPAGNQGFGLNASEADKEIK
ref|ZP_02170376.1|     FTEVIELDLGTIEPNLSGPKRPQDLIPLSQMKKEWRKALTAPVGNQGFGLEAAEADRSVD
RAAC01759              FTDTLELDLGSIQPTMAGPKRPQDKIFLSDMKNNFEAALEKPVSEGGFGLAD-QRDKTAL
ref|YP_001546865.1|    YTDTVHLDLSTIVPSVAGPKRPQDRVELQNTKASFQKSLTAPIAERGFALSTEKAENTAT
                       :*: :..::*. :   ...::*******  : * .* :.  ..:*  :  :    :.
```

FIG. 57B

```
ref|YP_001125323.1|    VTL-NGEQVSMKTGAVVIAAITSCTNTSNPYVLVAAGLVAKKAVEKGLQVPKYVKTSLAP
ref|YP_147200.2|       VEL-NGEQVKLKTGAVVIAAITSCTNTSNPYVLVAAGLVAKKAVEKGLQVPKYVKTSLAP
ref|YP_091630.1|       FKLENGEEAVMKTGAIAIAAITSCTNTSNPYVLIGAGLVAKKAVELGLKVPNYVKTSLAP
ref|ZP_02170376.1|     VKHPDGRTSQLKTGAVTIAAITSCTNTSNPHVMIGSGLLAKNAVDKGLEVPAYVKTSLAP
RAAC01759              VQYPDGHKDELHHGAVVIAAITSCTNTSNPSVMIGAGLLAKKAVEKGLKTPRYVKTSLAP
ref|YP_001546865.1|    VQN-NGHSATIGHGAVVIASITSCTNTSNPSVMLGAGLLAKKAVEKGLTVAPYVKTSLAP
                          :*.    :   :.:**********  *::..:::    .. ******* ref|YP_001125323.1|    GSKVVTGYLRDSGLLPYLQQLGFNVVGYGCTTCIGNSGPLAPELEKALAESDLLVTSVLS
ref|YP_147200.2|       GSKVVTGYLRDSGLLPYLEQLGFNIVGYGCTTCIGNSGPLAPELEKALAESDLLVTSVLS
ref|YP_091630.1|       GSKVVTGYLVNSGLLPYMRELGFNIVGYGCTTCIGNSGPLAPEIEKAVAENDLLITSVLS
ref|ZP_02170376.1|     GSKVVTGYLEDAGLMPYLDKLGFNLVGYGCTTCIGNSGPLPDEVEQAISENDLTVSSVLS
RAAC01759              GSRVVTDYLERSGLLEPLSKLGFDVVGYGCTTCIGNSGPLPEEVAKAIQENDLLVSAVLS
ref|YP_001546865.1|    GSRVVSSYLEQAELIEPLEALGFHVVGYGCTTCIGNSGPLPEPVAAAVQEGELVAAAVLS
                       ::.**    *:    :   *.:************.    :    *:  *.:*   ::*** ref|YP_001125323.1|    GNRNFEGRIHPLVKGNYLASPPLVVAYALAGTVDIDLLNEPIGKDKDGNDVYFRDIWPSM
ref|YP_147200.2|       GNRNFEGRIHPLVKGNYLASPPLVVAYALAGTVDIDLLSEPIGKGKDGSDVYFRDIWPSM
ref|YP_091630.1|       GNRNFEGRIHPLVKGNYLASPPLVVAYALAGTVDIDLKNEPIGVGKDGQNVYFNDIWPTM
ref|ZP_02170376.1|     GNRNFEGRIHPLVKANYLASPPLVVAYALAGTVDIDFETEPLGQDKEGNDVFFRDIWPSN
RAAC01759              GNRNFEGRIHSLVRANYLASPPLVVAYAIAGTVDIDLVNEPIGKDENGNDVFLRDIWPSN
ref|YP_001546865.1|    GNRNFEGRINPLVKAAYLASPPLVVAYALAGTINLDLATEPLGNDKEGNPVYLRDIWPSQ
                       *********:.**:. ************:***:::*: .**:*  .::*. *::.****:

ref|YP_001125323.1|    EEVKEVVKRAVDPELFRKEYERVFDGNPRWNAIETTDEPLYQWDEQSTYIQNPPFFEGLS
ref|YP_147200.2|       EEVKDVVKRAVDPELFRKEYERVFDGNPRWNAIETTDEPLYQWDENSTYIQNPPFFEGLS
ref|YP_091630.1|       DEINSVVKQTVTPELFRKEYERVFDDNERWNAIETTDEALYKWDEESTYIQNPPFFENMS
ref|ZP_02170376.1|     EEIHKSMQEAVDPKLFKREYKRVFDDNERWNALETPDGDLYEFDEESTYIQNPPFFENLS
RAAC01759              EEIQAVIRQIINPEMFKKEYESVFNRNERWNKLDVPKGELYEWDPNSTYIQEPPFFEGLS
ref|YP_001546865.1|    SEIQETVRKAIKPEMFTQQYGNVFAGSDAWKRVQAPTGNIYAWNNDSTYIQHPPFFQDLQ
                       .*::    ::.  :  *:* ::* **  . *:  ::..    :*   :: :*****.****:...

ref|YP_001125323.1|    PDVRKVEPLTGLRVVGKFGDSVTTDHISPAGSIGKSTPAGQYLISKGVEPKDFNSYGSRR
ref|YP_147200.2|       PEVRKVEPLTGLRVVGKFGDSVTTDHISPAGSIGKNTPAGQYLISKGVDPKDFNSYGSRR
ref|YP_091630.1|       VEPGTVEPLKGLRIVGKFGDSVTTDHISPAGAIGKDTPAGKYLQEKGVSPRDFNSYGSRR
ref|ZP_02170376.1|     PDPKDVEKLSGLRAVGKFGDSVTTDHISPAGAIAKNSPAGRYLMEKGLEPKDFNSYGSRR
RAAC01759              EEVPDIQEIQGARVLAYLGDSVTTDHISPAGSIAPSSPAGQYLQSKGVKPHEFNSYGSRR
ref|YP_001546865.1|    PEPAPIGDITGARVLALLGDSVTTDHISPAGSIAKNSPAAKYLIDNGVDPQDFNSYGARR
                         :      :    :  * *  .:.**********:*. .:**.:**  .:*:.*:::****:**

ref|YP_001125323.1|    GNHEVMMRGTFANIRIRNQIAPGTEGGYTTYWPTGEVMSIYDACMKYKQDGTGLVVVAGK
ref|YP_147200.2|       GNHEVMMRGTFANIRIRNQIAPGTEGGYTTYWPTGEVMSMYDACMKYKQDGTGLVVIAGK
ref|YP_091630.1|       GNHEVMMRGTFANIRIKNQIAPGTEGGYTTYWPTGEVMSIYDACMKYKEDGTGLVVIAGK
ref|ZP_02170376.1|     GNHEVMMRGTFANIRIKNQLAPGTEGGYTTHWPTGDVMAIYDACMQYKEEGTGLLVMAGK
RAAC01759              GNHEVMMRGTFANIRIRNKVAPGTEGGYTTYFPTGEVMPIYDAAMKYKADGTPLVVIAGK
ref|YP_001546865.1|    GNHEVMMRGTFANIRLKNLLLNGVEGGYTLYFPTGEQQSIYDASMAYQASGTPLVILAGK
                       ***************::*    :   *.***    ::*:    .:***.*    *:    .**   *:::*** ref|YP_001125323.1|    DYGMGSSRDWAAKGTFLLGIKTVIAESFERIHRSNLVLMGVLPLQFKEGENAETLGLTGK
ref|YP_147200.2|       DYGMGSSRDWAAKGTFLLGIKTVIAESFERIHRSNLVLMGVLPLQFKEGENAETLGLTGK
ref|YP_091630.1|       DYGMGSSRDWAAKGTNLLGIKTVIAESFERIHRSNLVLMGVLPLQFKEGENAETLGLTGK
ref|ZP_02170376.1|     DYGMGSSRDWAAKGTNLLGIKTVIAESFERIHRSNLVLMGVLPLQFKSGENADTLGLTGE
RAAC01759              EYGTGSSRDWAAKGTYLLGVKAVIAESFERIHRSNLVGMGVLPLEFIDGQNAETLGLTGR
ref|YP_001546865.1|    EYGTGSSRDWAAKGTYLLGVKVVIAESYERIHRSNLVGMGVLPLQYRAGESAASLGLKGD
                       :** ***********  ***:*  *****:*********  ******::   *::* :***.*
```

FIG. 57C

```
ref|YP_001125323.1|    EVFEVQ-IDESVKPRDLVKVTATNPDTGEKKEFEVIVRFDSEVEIDYYRHGGILQMVLR-
ref|YP_147200.2|       EVFDIH-IDENVKPRDLVKVTATNPDTGEKKEFEVIVRFDSEVEIDYYRHGGILQMVLR-
ref|YP_091630.1|       ETIEV-DVSESVRPRDLVQVKAIAED-GTVKSFEAVVRFDSEVEIDYYRHGGILQMVLRN
ref|ZP_02170376.1|     EHFDVH-VDNDVQPRQEIKVTATDSD-GKGTEFHVIARFDSEVEIDYYRHGGILQMVLRN
RAAC01759              EVYTIKGLSNDLKPRQTVTVEVTRED-GSSFTFQALVRLDSDIEVDYYRNGGILQTVLRN
ref|YP_001546865.1|    ESFSVEGINDDLQARSELTVRAVRPD-GSELSFQAVVRIDTPVEVEYYKNGGILHTVLRQ
                       *    :   :.:.::.*. :  * .   * *    *...:.*:*: :*::::: * ref|YP_001125323.1|    -------
ref|YP_147200.2|       -------
ref|YP_091630.1|       KMKQ---
ref|ZP_02170376.1|     -------
RAAC01759              FMREQHA
ref|YP_001546865.1|    LAK----
```

FIG. 58

```
ref|ZP_02015336.1|    MRAAILREYGEPLDIHEVPDPEPGPDGAVVRVTACGVCRSDWHAWAGHGEWADDRVP-RG
ref|YP_136548.1|      MRAAVIEEHGEPLTIQDVPYPEPQPDQVVIETEACGVCRSDWHAWQGDWEWFGIQTG-PG
ref|YP_055250.1|      MKAALVEQYHEPLAIRDIPEPAHDSDGVVVEVKACGVCRSDWHGWQGE--WPGFTGGSLP
gb|ABW71834.1|        VRAAQIVGYGEPLQVREVPDPAPEPGGVVVAVLATGICRSDWHGWRGDWEWLGGRIA-LP
RAAC01762             MKAARLHAFHTPFAIETVPDPEPGPEDAIVRVRAAGVCRSDLHIWQGELAWVGIRPQ-LP
ref|NP_102793.1|      MKAVVFEKFGEAPTIQTVPDPKPAADGVVIKVEATGLCRSDWHGWMGHD--DGITL---P
                      ::*. .    . :* *     . .::  . * *:****  * * *.     .

ref|ZP_02015336.1|    QVL---GHEPAGEVVTVGDSVDRFAPGDRVVVPFSLGDGTCPRCRQGHGNVCDDGRALGF
ref|YP_136548.1|      QIL---GHEPAGVVADVGADVEQFSEGDRVTVPFHLGDGSCQYCQRGHANICETSMPLGF
ref|YP_055250.1|      HIF---GHEFVGLVSDIGNNVSRYRVGDRVIVPFTLGCGHCEYCRSGHSNVCPTVSMPGF
gb|ABW71834.1|        RTP---GHEIAGEVVAAGPGVRGVRVGDRVTVPFHLACGTCAHCRAGQANLCDEMEVLGF
RAAC01762             ITL---GHEFGGEVVAVGRNVRRFVAGDRVTVPFHNGCGRCPQCQSGRSNLCDEFGFYGA
ref|NP_102793.1|      HVP---GHELAGVVVAAGKQVSRWKAGDRVTVPFAVGCGRCFECSSGNHQVCEHQTQPGF
                         *** * *   *  *    ** *  . *  * *  *. ::*       * ref|ZP_02015336.1|    EPEA-PGAFAERVAVPDADYNLVERPPWLDATAAAALGCRYMTAYHALAERAGLDGGEWL
ref|YP_136548.1|      LEAA-PGAFAEAFPVREADFNCVTLPDAVDFTEMAGLGCRFMTAYHALTDRATLRPGDAV
ref|YP_055250.1|      SYDG---GFAQYVTVPDADANLVKLPDAVDFTDAAGMGCRLMTAYHGIVEVGQIHPGDWL
gb|ABW71834.1|        WRDG---GYAEYVRIPHADFNCVRIPDGVTPLTASAIGCRFMTAFHAVDGQGRVRPGEWV
RAAC01762             TYDG---CFAEYVRVPNADFNLIHLPDEVDFVTAAAMGCRYMTGFHAVMR-GRVQPGEWV
ref|NP_102793.1|      TGWG---SFAEYVGIEHADTNLVRLPDEMEYATAASLGCRFVTSFRAIVDQGRVKPGEWV
                       .  :*: . :.** * :   *  :    ::***  :*.::.:    . :  *: :

ref|ZP_02015336.1|    AVHGCGGVGLSAVQLGDALGARIVAVDVDDDALSLARDLGADETVNPNDLDEETVPDRVR
ref|YP_136548.1|      AIHGCGGVGLSAVHIADALGAEPIAVDVQDRKLDRARDLGAAATIN--AAEADNVPGEVH
ref|YP_055250.1|      VVYGAGGVGLSATLVATSAGANVIAVDIADDKLALARKVGAIATIN--SRETDPV-EAVR
gb|ABW71834.1|        AVHGVGGVGLSCVQIASAAGASVVAVDIDPAKLALAEQQGAAHTVD--AGAEQDVPAAVR
RAAC01762             AVHGAGGVGLSAIQAAHAIGAQVIAVDIDDDKLEKARTEGAAVTIN--SRREERVFKAIK
ref|NP_102793.1|      AVHGCGGVGLSAIMIASSMGANVIAIDLTDEKLEFARKIGAVATIN--ASTTPNVVKAVK
                      .::* ******.    . : **  :*:*:      *   *.   **  *::    *  ::

ref|ZP_02015336.1|    NLTDGGADVSVDALGIAETCRNSVRSVRPRGTHVQVGLTTEAERGEVSLPTDWMTRWEVS
ref|YP_136548.1|      AVTDGGADVAIDALGIAETCRNAVGSLGKQGTHVQVGLTTDDEAGEIPLPVDTMTLQEID
ref|YP_055250.1|      ELTDGGADKSVDALGISETLHNAVNSLRSRGTHIQIGMTAEGPVGDVALTINDLIAKEID
gb|ABW71834.1|        EVTGGGAHVSIDALGIRTTVVNSVRSLRKRGRHVQVGLTGAEDAGEIALPIDLITLGELT
RAAC01762             QVTRGGAHVSIDALGLAETVFNSVRCLRKGGRHVQVGLTSSSEQGMVALPVDIMTTGEIE
ref|NP_102793.1|      QIANGGAHMSMDALGHPTTSFNSIANLRRGRHVQVGL-MLGEHARPQVPMDKIIAFELE
                      ::  ***. ::****  *  *:: :    *  *:*:*:      .  :. :  *:

ref|ZP_02015336.1|    FVGSRGMPPTSYDDLFALVEATDVDPAALVSEELALSEVSERLAAMGEYDARGVEVVTDF
ref|YP_136548.1|      FHGSYGMPPVRYDELFRLIDAGTLDPSQIVGETLALEDVPATLSSMGEYETVGIPVIDEF
ref|YP_055250.1|      FRGSFGMPAVEFRYLLNQVAAGKMKPGQLVTKTIALSEVNDALTAMSTYNTVGTTVITDF
gb|ABW71834.1|        VVGSHGNPHAAYPRLLSLIESGRLAPQTLVQRTVSLDQAGDVLAAMDAFATSGLTVIDRF
RAAC01762             FIGSFGNPHVAFDGLLRLVAAGRLRPKALVEREVSLAELNDVFHRMLRFETKGFNVITAF
ref|NP_102793.1|      ILGSHGMQAYRYQAMMDMIRNGKLKPELLVGKKISLDEAPAALMAMGGFEGIGIGVVTKF
                      . ** *       :  :: :      :  * :*   ::*.   :       *   * *: * ref|ZP_02015336.1|    -
ref|YP_136548.1|      -
ref|YP_055250.1|      -
gb|ABW71834.1|        -
RAAC01762             A
ref|NP_102793.1|      -
```

FIG. 59

```
ref|YP_190012.1|      MKTRAAVLYEMGAKKPYKESKPLKIEYLELDNPSEHEVLIKIHAAGLCHSDLSVINGNRP
ref|YP_252288.1|      MKTRAAVLYEMEASQPYKESKPLKIESLELEDPHEHEVLLKIHAAGLCHSDLSVINGSRP
ref|YP_300327.1|      MKTRAAVLREMGKDAPYTESHPLTIETLELQGPQSNEVLIKIGAVGLCHSDLSVINGSRP
ref|NP_693723.1|      MQVKTAVLRTQGADSPYKESKPIKIETLELDAPQLGEVLIQIKAASLCHSDLSVINGSRP
ref|ZP_01227084.1|    --TRAAVLRRSPVEGPYATSRPLSIETVELAPPGDGEVLVRIKAAGLCHSDLSVIDGVRP
RAAC01763             MQTRAAVLMEMGARPPYASTRPLRLETLELEPPGPGEVLIRVRAAGLCHSDLSVIEGARP
                        .:*  ::*: :* :** * ***::: *..**********:* ** ref|YP_190012.1|      RPLPMALGHEASGEVIKVGKAVTRVSEGDHVVCTFIPSCGKCIPCKEGRPALCENGAISN
ref|YP_252288.1|      RPLPMALGHEATGEVLKVGSSVTRVKEGDHVVCTFIPSCGKCIPCKEGRPALCENGAKAN
ref|YP_300327.1|      RPMPMVLGHEAAGEIIEVGENVAEFEVGDHIVCTFIPSCGHCIPCREGRPALCENGAAAN
ref|NP_693723.1|      RPLPMALGHEASGVVVEVGEGVTYLEPGDHIVCVFVPSCGHCVPCKEGRPALCEPGADSN
ref|ZP_01227084.1|    RPTPMVLGHEAAGIVETVGAGVDDLAPGDHVVMFVPSCGHCSPCAEGRPALCEPGNARN
RAAC01763             RPMPMALGHEAAGEVVELGEGVTDLAPGDHVVCAFVPSCGHCAPCQEGRPALCEPGAEAN
                       .******:* : :* * . ***:* .*:****:*  ****** * * ref|YP_190012.1|      EKGEMLEGGMRLSND-EGKVYHHLGISGFAEYSVVSENSIVKIDKKIPFERAAAFGCAII
ref|YP_252288.1|      EKGEMLEGGIRLSNE-DGQVYHHLGVSGFAEHAVVSENSIVKISNEIPFERAAVFGCAVI
ref|YP_300327.1|      EKGEMLEGGFRYESDRDEVMHHHLGVSGFADYAVVSTNSIVKVDKKIPFEKVAIFGCAVI
ref|NP_693723.1|      TAGTLISGGIRLHAD-GEAINHHLGVSAFSEFAVVSRNSLVKVKKDIPFEKLALFGCAVI
ref|ZP_01227084.1|    GEGTLLSGERRLSCE-GEPVHHHLGVSAFAERSVLSRRSLIKIDPELPLEIAALFGCAVL
RAAC01763             GRGTLLSGARRLRLG-GQPVHHHLGVSAFSDYAVVSRRSLVRIDPSLPFEHAALFGCAVM
                      * ::.* * : ****:*.*:: :*:* .*:::: ..:*:* * ****::

ref|YP_190012.1|      TGIGAVVNTAQIRSGSNVAVVGLGGIGLNAIIGAKLAGANEIIALDINEDKFELAKQFGA
ref|YP_252288.1|      TGIGAVMNTAQIRPGSNVAVVGLGGIGLNAIIGAKLAGANEIIALDINEDKFDLAKQFGA
ref|YP_300327.1|      TGIGAVINTARINAGSTVAVVGLGGIGLNAILGARLAGASEIIALDINEEKFALAKSLGA
ref|NP_693723.1|      TGVGAVVNTANVKLGSTVAIVGLGGIGLSALLGAVAAGASRIIAVDINENKLKQAKELGA
ref|ZP_01227084.1|    TGVGAVVNTGRVKAGETVAVVGLGGVGLSAILGAVAAGASRIIAVDLQADKLDMAKTLGA
RAAC01763             TGVGAIVNTARVPVGASVGIVGLGGVGLAALLGAVASSARHIAAIDVNPEKLAFARELGA
                      **:**::**..: * .*.:*****:** *:** :.* .* *:*:: :*: *: :**

ref|YP_190012.1|      TATFNSSDKDIDEQIKEYIPGGVEYAFETAGVVPAMKVAYQITKRGGTTVTTGLPNPKDN
ref|YP_252288.1|      TATFNSSDDDIDEQIKEYVPGGVEYAFETAGVVPAMQVAYRITKRGGTTVTTGLPHPKDE
ref|YP_300327.1|      TAVFNSGEAHTIEDIKQYTQGGVDYAFETAGVVPAMDVAYQITRRGGMTTTTGLPDPKHQ
ref|NP_693723.1|      TDVFNSTEETVIQQIKEATDGGVNYAFETAGAVPAMEVAYGITKRGGTTVTTGLPHPEHQ
ref|ZP_01227084.1|    TDIFNAGEAGVADAVRAATGGGVDHAFEMAGSARALELAFAITRRGGATVTAGLTPPTAT
RAAC01763             THTYDARDPGVIDKVRADSAGGLEYVFETAGSVAAMKTAFMVTRGGTTVTTGLPDPRHE
                      * :::  :   : ::   :::. ** . *:. *: :*:*** *.*:**. * ref|YP_190012.1|      FSFPQVTLAAEERTIKGSYVGSCVPDRDIPRFVNLYNQGRLNIDSLISEVITLDEINEGF
ref|YP_252288.1|      FSFPQVTLAAEERTVKGSYVGSCVPDRDIPRFVSLYKQGRLNIDPLISEVITLDDINEGF
ref|YP_300327.1|      FSFPQVTLAAEERTIKGSYVGSCVPDRDIPRFINLYHQGRLPVNELLTDTLPLEHINEGF
ref|NP_693723.1|      FSFPYVTLTAEEKTLKGSYVGSCVPDRDIPRYMNLFKQDRLPVDKLMTDFISLDEINEGF
ref|ZP_01227084.1|    MALSPLKLVAEEERTLKGSYVGSCIPSRDIPRYIALYRGGRLPVDRLLTSRGTLDDINEGF
RAAC01763             WSVPQVLLAAEEERTIRGSYVGSCIPSRDIPRFISLFQQGKLPVDRLVSDVIDLDHINEGF
                      :.. : *.***:*::*******:*.*****:: *:. ..:* ::  *:::.   *:.***** ref|YP_190012.1|      DRLSNGEVGRIIMKM---
ref|YP_252288.1|      DKLASGDVGRIIVKM---
ref|YP_300327.1|      DRLARGEAARLVVKM---
ref|NP_693723.1|      DKLAKGDSSRIIIKM---
ref|ZP_01227084.1|    DALAAGRTVRHVV-----
RAAC01763             DRLAAGEAVRIVVRMSGA
                      * *: *   * ::
```

FIG. 60

```
ref|ZP_01860323.1|    -LTIAMPKGRIFDEALELLRQAGYNLPPEFDDSRKLIIEVP--EEKLTFILAKPMDVPTY
ref|ZP_01171654.1|    LLTIAMPKGRIFEEAAELLRQAGFDLPPEFDDSRKLIIDV--EEERFQFILAKPMDVPTY
ref|NP_244450.1|      MLTVAMPKGRIFDEAVGLLRKAGYNLPAEFEASRKLIVDVP--EENMRFILAKPMDVPTY
ref|YP_080823.1|      -LTIAMPKGRIFEEAADMLRKAGYQLPEEFDDSRKLIIQVP--EENLRFILAKPMDVTTY
ref|YP_148929.1|      MLTIAMPKGRIFEEAVELLRRADYALPPEFTESRKLVIDVP--EENMRFILAKPMDVVTY
RAAC01767             MLTVAMAKGRTLDDVVPLWEEAGIPYPRDWDESRALVFEIPWRDWTLRYLLAKPADVPTY
                       :.***  ::: .   :  ..*.    *  ::   **  *:.::    :    :   ::**  ** ref|ZP_01860323.1|    VEHGVADLGIAGKDVMLEEERDVYELLDLKISACYLAVAGLP-GTKMNEVAPK-IATKYP
ref|ZP_01171654.1|    VEHGVADLGIAGKDVMLEEERDIYELLDLKISACYLAVAGIP-GTKMNEVAPK-VATKYP
ref|NP_244450.1|      VEHGVADVGVAGKDVMLEEERDVYEVLDLKISECYLAVAGLPNYEKKHDLNPK-VASKYP
ref|YP_080823.1|      VEHGVADVGIAGKDVLLEEERDVYEVLDLNISKCRLAVAGLP-ETAADTVAPR-VATKYP
ref|YP_148929.1|      VEHGVADLGIAGKDVLMEEERDVYELLDLHISRCHLAVAGMP-GAKMNEIAPR-VATKYP
RAAC01767             VAYGVADLGIVGNDILLEQEREMYELLDLGVARCKLCVAGRE---EERRHAPRRVATKYP
                      * :****:*:.*:*:::*::::***  ::  *  *.***           *: :*:*** ref|ZP_01860323.1|    TIASSYFREQGEQVEIIKLNGSIELAPMIGLADRIVDIVSTGRTLKENGLVEYEKIVDIT
ref|ZP_01171654.1|    NVAAAYFREQGEQVEIIKLNGSIELAPLIGLSDRIVDIVSTGRTLKENGLVEYEQIVGIT
ref|NP_244450.1|      HLATRYFKEQGEQVEIIKLNGSIELAPLIGLADRIVDIVSTGRTLRENGLVELEKMMTIT
ref|YP_080823.1|      NVASSYFREQGEQVEIIKLNGSIELAPLIGLAGRIVDIVSTGQTLRENGLVETEKICDIT
ref|YP_148929.1|      NIASTYFREQGEQVEIIRLNGSIELAPLIGLADRIVDIVSTGRTLRENGLVELERIAEVT
RAAC01767             KLADRYFRSQGHQVEIVPLAGSIELASVIGLTDRIFDLVQTGETLRANGLVVFDEVLDIS
                       :*   **:.**.****: *  ****** .:***:.**.*:*.**.**:  ****   :.:   ::

ref|ZP_01860323.1|    SRLIVNPVSYRMKDERIDELAERLREVVS-------
ref|ZP_01171654.1|    SRLIVNPVSYRIKDKRISEIVDKLSRVVNEQAA---
ref|NP_244450.1|      SRLIVNPVSYRMKDERIDMVERL-------------
ref|YP_080823.1|      SRLIVNPVSYRMKDAVIDEMASRLSLIVEGEKA---
ref|YP_148929.1|      SRLIVNPASYRLNGGDIERLVDRLAAVI--------
RAAC01767             ARLVANRSSYRMKHREISACLERLEAAVARRNAYAP
                      :**:.*  ***::   *.   .:*
```

FIG. 61

```
ref|NP_388333.1|           ---------------------IADEFQQTAAEDDEQGRFPAEKIQKLRDAGYTALTLP
ref|YP_001375327.1|        ---------------------FQERECELRELGSFPFENINELKDIGYTTLTLP
ref|NP_691214.1|           ------------KRIQLLK---NTVAPFNERAQKHDKDVSFPFENYKDLQSIGYPSLTIP
ref|ZP_01170331.1|         ------KAAGEADKYEQMK---ELSAIFKERSRSKENRGSFPHRNILDLKASGYTSLTVP
ref|YP_076186.1|           --------------RRFVALAGELADRFAGRAALHDRENSFPFENFAELRASGYVRLTVP
RAAC01797                  MYDIYGEAALPADVRERLRITRDLAQAFHERAPEHDRAGDFPFENIEDLKASGYVRWTVP
                                                   *       .   **  .:  .*:  **    *:* ref|NP_388333.1|           ASHGGGGISVYDMLLFQERLARGDAPTALSIGWHLSVIGELGEGNSWDEDVFAFVAKEV-
ref|YP_001375327.1|        KDCGGQEISLYDFVLYQEKIAEGDGATALSIGWHLGIVKELTENQSWKPDMFAWFCEEV-
ref|NP_691214.1|           KEYGGAGITLDELLTYQEIIAQADGSTALSIGWHMGIMKYLGENKIWNEDVYSTVANDVI
ref|ZP_01170331.1|         ADRGGKGISLLEMIRLQEKLAEGDGSTALAIGWHMGITKNLGEKRKWDDELFSFLCREIL
ref|YP_076186.1|           VEWGGEGANLTETLLAQERLAQGDGATALGIGWHLAVVGKLAETRAWPPAATARIFREVA
RAAC01797                  VEYGGLGLSLEEMLMHQEVLAKGDGSTALAIGWHVGILLHLRETGAFPDELFRMVCESVV
                             **     .: :  :   **  :*..**.**** ::   *  *    :      ...:

ref|NP_388333.1|           QNGAVINRAATEAKTGSPTRGGRPGTHAVKKDGKWAVNGRKTFTTMSQALDYFLVTAWIE
ref|YP_001375327.1|        KKGALFNRAATERKTGSPTRGGRPETLAVKKGEKWIINGRKTFTTMAPMLDYFIISASIE
ref|NP_691214.1|           QNGALLNNAATEPATGSPTRGGKPETHAIKQGNKWIMNGRKTFTTLSPILTYFVVSATID
ref|ZP_01170331.1|         -DGKLINSAATERQTGSPTRGGRPQTTAVLKGGNWVISGRKTFTTMAPALDYFIVSAFIP
ref|YP_076186.1|           GRGALINSAASEVETGSPSRGGRPTTTARRAPGGWLLTGRKSFTSLAPVLDYAVVSASFE
RAAC01797                  KEGALINSCATEPATGSPSRGGKPETTAVKVPGGYRITGRKTFSTLSPALTWIMVTATVA
                              * ::*  .*:*  ****:***:*  *  *           :  :.***:*:::   *  :  :::* .

ref|NP_388333.1|           DKQTTGVFLIHKDDPGLSIEETWDMMAMRATGSHDLVLNEVMLDENKLVEL----LQGPR
ref|YP_001375327.1|        GREEIGEFVVPRAQKGVSIEETWDSVAMRGTASHDLVLRNVEISDKYFTDIKG----SQS
ref|NP_691214.1|           ETGEVGNFLIKRDRPGVNVEETWDSIAMRGSGSHDLVLENVHLDEENLVEILS-----NK
ref|ZP_01170331.1|         SEDKTGNFLVPREAEGLSIEETWDSVSMRGTGSHDLVLDEVSIDKTFLAEILG------Q
ref|YP_076186.1|           GSDGGGWFLVQTGSPGVTVVETWDALGMRATGSHDLVLEDVFVEDGDLLETFG--RGNTC
RAAC01797                  DEDVVGQFLVRK--EDVEIVETWDTLGMRATGSHDIVLKDVFVPEERVIVIQR--PGVQA
                                  * *::       .: :  ****  :.**.:.***:**  :* :   .   .

ref|NP_388333.1|           GAKP------NGWLLHIPAIYLGVAQAARDYAVQFASEYSPNSLNGPIKNVPAVQQRTGE
ref|YP_001375327.1|        KPKG------VGWLLHIPACYLGIAQAARNYALRFAESYQPNSLKHPISSLPNIRRLVGE
ref|NP_691214.1|           KRKP------AGWLLHIPACYLGIAQAAQKEAVQFAMNYSPNSIEGTISDLPNVKQKMGD
ref|ZP_01170331.1|         DKKA------NGWLLHIPAVYLGIAQAAQDYAAGFAKSYSPNSIQGTISDIPSVQQKIGE
ref|YP_076186.1|           QVGTG---DGAGWALHIPAVYLGIARAAHGFAVEYARTRRPNSLPGPIADQPHIQALLGQ
RAAC01797                  ERRP----DGSGWLLHIPACYLGIALAARDFALEYAATYRPNTLPHPIAEVPHVEQKLGE
                                         **  *****  ***:*  **:   *   :*     **::   .* . *  :.  *:

ref|NP_388333.1|           MELELLNARHFLFHIAQLYD--DPVRRPHLTSELGAAKHIVTNAALSVVDKAMRIVGAKS
ref|YP_001375327.1|        LELELMQARMFLYQIAKKYDEV--DDKQSLQAELAAAKYIATNAAISVVDKAMRIVGAKS
ref|NP_691214.1|           LELLLMESKHFLHSIAQQWDNGDENIRVAMGPELGAAKLSVTNKAVHAVDLAMRIVGAKS
ref|ZP_01170331.1|         IELELMRAREFLYAAADRWDRAAENERESMQPLLGAVKLAVTNAALTVADLAIRVVGARS
ref|YP_076186.1|           NEIDLLAARSALYTVADRWD-AEPERRGELVPLLGAAKVLAVNLALQIVDRAMRVAGIAG
RAAC01797                  MELKLLAARTLLYDLARRFDAASPEERVKLQPQFGAVKTLATNAANQVVDLAMRVVGGRS
                            *: *:  ::   *.  *  :*        :    : .  .*.*   ..* *    .* *:*:.*  .

ref|NP_388333.1|           LERTNPLQRYYRDVRAGLHNPPMDDAV------------
ref|YP_001375327.1|        LSEKNPLHRYYLNVRAGLHNPPMDDV------------
ref|NP_691214.1|           LSEKNNLQRYYRDVRAGLHNPPMDDM------------
ref|ZP_01170331.1|         LSEQNPLQQYYLDIRAGLHNPPMDDM------------
ref|YP_076186.1|           LFRQLPLERLYRDVRAGLHNPPMEDAV------------
RAAC01797                  LSRALPLERYYRDVRAGLHNPPMDDVVYRNLAKAALARRAAGQAGR
                            *  .   *.: *  * ::*********:*
```

FIG. 62A

```
ref|NP_242876.1|          ---------AIYTRQFLAGEWIEGASTQTITNYNPYTGEKIHEIKGASLDDLDQAYRAAK
RAAC01900                 MSSTTSVKYAQWNKLYLGGEWRSGTSSRTVTVRNPYNQEVLAEFPLASVEDIDQAYRKAQ
ref|NP_691405.1|          ---------YENLNKNFISGEWRDGQGETTYEVKNPYNDEVLQEIKMASKEDIDEAYKSAE
ref|YP_001420375.1|       --------QYEELNKQFIGGRWRDGSSRNVLENRNPYTQKVITSFQKATSDDVDAAYRAAA
ref|NP_388616.1|          --------QYEELNKQFIGGKWQEGSSPNVLENKNPYTQKTFTTFRKATADDVDEAYRAAA
ref|NP_241871.1|          ------------NKQYIDGEWRDGKSPRVLRDRNPYNQEVLAEFQIATDSDVDAAYHAAL
                                      .: :: *.* .* .  .       ***. : :   *: .*:* **: * ref|NP_242876.1|          NAQKEWEQTLPAQKQEVLEKAAALLAERKDEVIERLVNEAGSSIIKASIEWGATLQTIKV
RAAC01900                 AAQQGWAEESAFTRAEVMERAASILAQRKDEIVRYLVEETGSSQLKASIEVDASIGDIKL
ref|NP_691405.1|          QAKKKWAKFNPFERSSIMEKAVQIIDARREEFVNHLIREGGSSHLKANVEIDFVIAITRE
ref|YP_001420375.1|       LAKQEWDKVNPFKKRAILEKAVSFIEEHEEAIIYLIMEELGGTRLKAEFEIGLVKNMIKE
ref|NP_388616.1|          LAKKKWDAVNPFEKRTILEKAVTYIEENEEAIIYLIMEELGGTRLKAAFEIGLVKNIIKE
ref|NP_241871.1|          KAQNEWATVNPYRKREILERAVTYIEEHEEEIVAIIIDELGGTRLKAAFEIGLVKNMIKE
                           *::  *   .  :  ::*:*.  :   ..: .:   ::  *  *.: :** .* .    :

ref|NP_242876.1|          AATFPLRMEGKILPSNIPGKENRIYRSAKGVIGVISPFNFPLVLAMRSVAPALATGNAVV
RAAC01900                 AAEYAHKMTAVILPSAIPGKENRVYRTPVGVVGAITPWNWPFYLSIRVVAPALATGNAIV
ref|NP_691405.1|          AASFPLRMSGEIVPSLIPGKENRIYRSPLGVVGVIGPFNFPMYLAMRSVAPALAVGNGVV
ref|YP_001420375.1|       AATFPVRMEGKILPSTIDGKENRLYRIPAGVVGVISPFNFPFFLSMKSVAPALGAGNGVV
ref|NP_388616.1|          AATFPIRMEGKILPSTIDGKENRLYRVPAGVVGVISPFNFPFFLSMKSVAPALGAGNGVV
ref|NP_241871.1|          ASTFPLRMEGKILPSTENGKENRLYRVPAGVVGVISPFNFPFFLSVKSVAPALGAGNGVV
                          *: :. :* . *:    *:  . **:*.* *:*:*: *::: ***...:* ref|NP_242876.1|          LKCSSDAPITSGLLIAELFEEAGLPKGVLNVVVGKAAEIGDAFVTHPIPKLISFTGSTEV
RAAC01900                 LKADSQTPITGGLLVADLFEQAGLPPGLLSVVVADLDEIGDAMVEHPVPRVISFTGSTAA
ref|NP_691405.1|          LKPDDQTAVTGGILLAKVFEEAGLPKGVFNVVVPNIEDIGDAFVEHPIPRLISFTGSTPV
ref|YP_001420375.1|       LKPHEETPICGGTLIAKIFEAAGVPDGLLNVIVTDIGEIGDSFVEHPVPRIISFTGSTGV
ref|NP_388616.1|          LKPHEETPICGGTLIAKIFENAGIPAGLLNVVVTDIAEIGDSFVEHPVPRIISFTGSTKV
ref|NP_241871.1|          LKPHEETPITGGTLIAKIFEEAGVPKGLLNVVVTEIDEIGNAFVEHPIPRIISFTGSTNV
                          **   .:: .: .*  *:*:.:** **:* *::.*:* .  :**::: **:*:*:*******   .

ref|NP_242876.1|          GRHIAQLAARELKETALELGGNNVMIVLDDADIEKAAEKAAVGKFLHQGQICMALNRIIV
RAAC01900                 GRHIAEVAARSLRKVALELGGNNVFIVLDDADVDQAVAAAAFGKYLHQGQICIATNRMIV
ref|NP_691405.1|          GRHIGEICGRNIKKVALELGGNNVPLVVLEDAKVENAVNSALFGKFMHNGQICMAINRIIV
ref|YP_001420375.1|       GSYIGQLAVKHFKKPLLELGGNSALIVLEDADLEYAVNAAVFSRFTHQGQICMSANRVLV
ref|NP_388616.1|          GSYIGQLAMKHFKKPLLELGGNSAFIVLEDADIEYAVNAAVFSRFTHQGQICMSANRVLV
ref|NP_241871.1|          GSHIGQLAVKHFKKPLLELGGNSAFLIFADADLDYAVQAATFSRFTHQGQICMSANRIFV
                          * :*.::. .  :   :::  ****. :::: .::  *.  *  ...::  *:**:: ::.* ref|NP_242876.1|          DASIYDSFVEVFKEKVSQLQTGNPAEPATLIGPLINYKQIGRIQQLVKESVAQGAVKVLE
RAAC01900                 HRKVYDEFVEKFMAATEKVKVGDPADPETVICPLINERQAKRIMGLIDESLKMGARLVLE
ref|NP_691405.1|          HKDIYEEFVEKFVEKAKKIKVGNPSEKDNLIGPLINRQAIDRILEQIESAKEQGAEVVLE
ref|YP_001420375.1|       HTSVYDKFTELYEAKVSSLKVGDPMDPDTVIGPLINERQAEGLRRSVEKAIEEGAVPVLS
ref|NP_388616.1|          HSSIYDKFLELYQAKVESLKVGDPMDPDTIIGPLINSRQTDGLMKTVEQAIEEGAVPVKL
ref|NP_241871.1|          QRDVYDEFVERYVTKVASLKVGDPRDPETVIGPVMNSRQAETLKQAIESGIAAGAKPVLH
                          . . :*:.* *  :     . .::.*:*  :   .:*  *:*  :    :     :... ** * ref|NP_242876.1|          GHVQGNLMSPTILSEVTNDMPVAKEEIFGPIAPIIKAKDEAEAIAIANDSPYGLSGSIFT
RAAC01900                 GKLEGLLMYPYILADVTNDMPIAKNEIFGPVAAILPVDSEEEAVNIANESDYGLSGAVFT
ref|NP_691405.1|          GKVEGNVMHPYILTG-SNDVATAQNEMFGPVATIISAESDEEAIRIANDTPFGLSGAVHA
ref|YP_001420375.1|       GRFSGTVAEPVILKDVKPEMSIAKEELFGPAVCIMTFETEDEAVSIANATPFGLSGAVHT
ref|NP_388616.1|          GGFNGTIVEPTILKDVKPFMSIAKEELFGPVVSFMKFDSEDEAVDIANETPFGLSGAVHT
ref|NP_241871.1|          GAISGNMVEPTILIDASPEMAIAQEELFGPVVCVIPFDTEEEAVEMANDTKYGLSGAIHT
                          *  ..* :  *  **  .  :. *::*:***  . .:  . : **: :**  : :****:::.:
```

FIG. 62B

```
ref|NP_242876.1|      GSLHRGVQVAKQIDTGMIHVNDQPVNEEAHISFGGEKDSGIGRFGGEWVLDKFTTVKWIS
RAAC01900             GDLERGIRVAQRIVTGMIHVNDQTVNVESNVPFGGEKASGIGRYCGEWGIEEFTTLKWIS
ref|NP_691405.1|      GSPERGVEVAKQITSGMVHVNDQSVNDEPLIAFGGEKASGLGRFGGKWSLEEFTTVQWIS
ref|YP_001420375.1|   ANVERGVEFAKRIETGMIHVNDTTINDEPNVAFGGEKQSGLGRLNGEWSLEEFTTLKWIS
ref|NP_388616.1|      SNLERGVAFAKRIETGMIHVNDTTINDEPNVAFGGEKQSGLGRLNGEWSLEEFTTLKWIS
ref|NP_241871.1|      ANVERGVEIAKRIQTGMIHVNDITINDEPIVAFGGEKHSGLGRLNGEWSLEEFTTLKWVS
                      ..  .**:  .*::* ::**  .:* *. :.*** :**   *:* :::***::*:* ref|NP_242876.1|      IQEKERVYPF-
RAAC01900             VQKEPRVYPFS
ref|NP_691405.1|      VQTEERENPF-
ref|YP_001420375.1|   VQHEKRQFPY-
ref|NP_388616.1|      VQHEKRSFPY-
ref|NP_241871.1|      VHYSQRVFPY-
                      ::  .  *   *:
```

FIG. 63

```
ref|NP_390790.1|        ---RKKVSVIGAGFTGATTAFLIAQKELADVVLVDIPQLENPTKGKALDMLEASPVQGFD
ref|YP_080204.1|        --KRNKVSVIGAGFTGATTAFLTAQKELADVVLVDIPQLENPTKGKALDMLEASPVQGFD
sp|Q59202|MDH_BACIS     -IKRKKISVIGAGFTGATTAFLLAKKELGDVVLVDIPQAENPTKGKALDMLESSPVLGFD
ref|ZP_02170616.1|      -IKRRKITVVGGGFTGTTTALMTAQKELGDVVLIDIPKMEDPTKGKALDMMEASPVQGFD
ref|NP_693087.1|        -LKRKKISVIGSGFTGATTALMVAQKELGDVVLVDIPDMEDPTKGKALDMAEAAPVQGFD
RAAC01939               MLERKKISVIGAGFTGATTAFLLAAKELGDVVLLDIPSLENPTKGKALDMLEAMPVLGSD
                         *.*::*:*.**:*::  * *.:*. *:********  *: ** * * ref|NP_390790.1|        AKITGTSNYEDTAGSDIVVITAGIARKPGMSRDDLVSTNEKIMRSVTQEIVKYSPDSIIV
ref|YP_080204.1|        ANITGTANYEDTAGSDIVVITAGIARKPGMSRDDLVATNEKIMRSVTKEVVKYSPDCIII
sp|Q59202|MDH_BACIS     ANIIGTSNYEETADSDIVVITAGIARKPGMSRDDLVQTNQKVMKSVTKEVVKYSPNSIII
ref|ZP_02170616.1|      SKITGTSDYKDTAGSDIVVITAGIPRKPGMSRDDLVSTNAGIMKSVTQEIVKYSPDCYII
ref|NP_693087.1|        AKITGTSNYADTEGSDLVIITAGIARKPGMSRDDLVNTNANIMKSVTKEIVHYSPNTTIV
RAAC01939               ARVVGTSNYEDTAGSDLVIITAGLPRKPGMSRDDLVNTNANIVKSVTEQVVRHSPDACLI
                         :.: **::* :*  .**:*:****:.********** **   :::***:::*::**:  ::

ref|NP_390790.1|        VLTNPVDAMTYAVYKESGFPKERVIGQSGVLDTARFRTFVAEELNLSVKDVTGFVLGGHG
ref|YP_080204.1|        VLTNPVDAMTYAVYKESGFPKERVIGQSGILDTARFRTFVAQELNLSVKDITGFVLGGHG
sp|Q59202|MDH_BACIS     VLTNPVDAMTYTVYKESGFPKHRVIGQSGVLDTARFRTFVAQELNLSVKDITGFVLGGHG
ref|ZP_02170616.1|      VLTNPVDAMTYTVFKESGFPKNRVIGQSGVLDTARFNTFVAEELNVSVEDVTGFVLGGHG
ref|NP_693087.1|        VLTNPVDAMTYTVFKESGLPKERVIGQSGILDTARFRTFVAEELNLSVKDVTGFVLGGHG
RAAC01939               VLSNPVDAMTYAVAYKTSGFPKQRVIGQAGVLDTARFNTFVAMELGVSVEDVHGFVLGVHG
                        :******...:* :.*****:*:****     **:.:*: *** ref|NP_390790.1|        DDMVPLVRYSYAGGIPLETLIPKERIDAIVERTRKGGGEIVNLLGNGSAYYAPAASLTEM
ref|YP_080204.1|        DDMVPLVRYSYAGGIPLETLLPKDRIDAIVERTRKGGGEIVNLLGNGSAYYAPAASLTEM
sp|Q59202|MDH_BACIS     DDMVPLVRYSYAGGIPLEKLIPKERLEAIVERTRKGGGEIVNLLGNGSAYYAPAASLVEM
ref|ZP_02170616.1|      DDMVPMLRYSFAGGIPLEKLIDKERLEAIVERTRKGGGEIVNLLGNGSAYYAPAASIVQM
ref|NP_693087.1|        DDMVPLIRYSYAGGIPLEKLIPQERLDAIVQRTRTGGGEIVNLLGNGSAYYAPAASLTVM
RAAC01939               DDMVPLVRYANVGGVPLEKLLPKERIDAIVERTRNGGGEIVSLMGNASAYYAPAASLLQM
                        ***:::  .:*.*:  ::*::*:*.******.*:.*******:  * ref|NP_390790.1|        VEAILKDQRRVLPTIAYLEGEYGYEGIYLGVPTIVGGNGLEQIIELELTDYERAQLNKSV
ref|YP_080204.1|        VEAILKDQRRVLPTIAYLEGEYGYEGIYLGVPTIIGGNGLEQIIELELTETEKSQLDKSV
sp|Q59202|MDH_BACIS     VEAIVKDQRRVLPAIAYLEGEYGFEGIYLGVPTILGGNGLEQIIELELTDEEKAALEKSA
ref|ZP_02170616.1|      VEAILKDKKRILPTIAYLEGEYGYSDLYLGVPTVIGGDGIEQVFELDLNDDEKAALDKSV
ref|NP_693087.1|        AEAILKDQRRVLPTIAYLEGEYGYQDIYLGVPTILGGEGIEEIIELDLTKEEKAQLDKSA
RAAC01939               AESILKDKRRVLPAIAYLEGEYGYRDLTLGVPTVLGKGGIERILELELLPEEKAALDKSA
                        .*:*:**::*:**:*********:  .:  *****::*  *:*..::**:*    *:: *:**.

ref|NP_390790.1|        ESVKNVMKVLS
ref|YP_080204.1|        ESVKNVMKVLS
sp|Q59202|MDH_BACIS     ESVRNVMKAL-
ref|ZP_02170616.1|      ASVKKVMEIL-
ref|NP_693087.1|        DSVKNVLNVL-
RAAC01939               ESVRRLISVLS
                        **:..::.  *
```

FIG. 64

```
ref|YP_001126997.1|    --------------------------------------------------FTKMHGLGNS
ref|YP_148810.1|       --------------------------------------------------FTKMHGLGNS
ref|YP_001488092.1|    -------------------------------------------------QFTKMHGLGNN
ref|NP_391097.1|       -------------------------------------------------RFTKMHGLGNS
ref|NP_244279.1|       -------------------------------------------------MKFTKMHGLGNS
RAAC01996              MSEMVSLAVRFRISTAANDYIIQGITQVCNESFHRWPDFFNRAQGGVGMQFFKMHALGNN
                                                                        * ***.***.

ref|YP_001126997.1|    YIYVDLFRETLPEEDLPAIARSVADVHTGIGSDGLILICPSEQAPVKMRIFNSDGSEGKN
ref|YP_148810.1|       YIYVDLFRETLPEEELPAIARSVADVHTGIGSDGLILICPSEKAPVKMRIFNSDGSEGKN
ref|YP_001488092.1|    YIYVNQMKEQLPEEKLSEIAIQVSSIYTGIGSDGMILICPSDVAPVKMRIFNNDGSEGKN
ref|NP_391097.1|       YIYVNQFEEQLPEEKLSEIAIQVSSVYTGIGSDGMILICPSDQAPVKMRIFNNDGSEGKN
ref|NP_244279.1|       YIYVDCFKELLKEEELPALAVAVADKNKGIGSDGMILICPSDRAPVKMRVFNNDGSEAKN
RAAC01996              YVFVDTARTTLPTDDLPSLARRVSDVRRGIGSDGLILVTPSDSADVGMRIWNADGSEAES
                       *::*:    .  *  :.*. :*  *:.  ******:**: **: * *  **:: * ****.:.

ref|YP_001126997.1|    CGNGLRCVAKYAYEHGIVRDRSFLIETLSGLVEAEVTVE-NGEVTSVTIDMGEPRLRRSA
ref|YP_148810.1|       CGNGLRCVAKYAYEHGIVSDRTFLIETLSGLVEARVAV-ADGEVTSVTVDMGEPRLERSA
ref|YP_001488092.1|    CGNGLRCVAKYVYEHQIVTDTTFQIETLSGLVEATVHVQ-DDHVHLVTVDMGKPRFEKEA
ref|NP_391097.1|       CGNGLRCVAKYAYEHKLVEETSFLIETLSGLVKAEVQVE-NGKVNVVTVDMGEPRLTKSE
ref|NP_244279.1|       CGNGLRCVAKFAFEHGYVKETSFDVETLGGLVKATVHPNDNGLVDTVTVNMGEPRLGRAQ
RAAC01996              CGNGLRCVARYAYERGLVDATHFSIETKAGVVAAQVHLDVEGRVRLVTIDMGEARFGTEA
                       *********::..*:  *       * :** .*:* * *      :.  *  **:.**:.*:

ref|YP_001126997.1|    IPM--TGPE-AEQVVAESFAIDGREYEITAVSMGNPHVIFYVDDIEKAPVTTLGPVVEKD
ref|YP_148810.1|       IPM--LGPE-AERVVAEPFAIAGGEYEITAVSMGNPHVIFYVDDIQKAPVTTLGPLVEKD
ref|YP_001488092.1|    MPM--LGEP-ASTTINEPLDFGTTTLNGTAVSMGNPHIVFYLEDIEKAPLDTLGPIIEKH
ref|NP_391097.1|       LPM--LDGG-EEHTINETMAFGEVELTGTAVSMGNPHIVFPIADIEQAPLTTLGPVIEKD
ref|NP_244279.1|       IPM--LGEE-AAEVVAEPFTIGEKEYRLTAVSMGNPHAIMFIDTIEDAPVEQVGPLLEKH
RAAC01996              VPY----RG-ADRGEDVRVEAGGARYTGTLVSMGNPHFVTLVDRVDDVDVERVGRVIESH
                       :*                  .            * ******  :   :::..  :  :* ::*..

ref|YP_001126997.1|    ARFPEGVNVEFVEVVSERELHFRVWERGSGVTQACGTGACAAVVASVLNGKTARGVETVV
ref|YP_148810.1|       PRFPEGVNVEFVEVVNERELHFRVWERGSGVTQACGTGACAAVVASVLNGKTARGEETVV
ref|YP_001488092.1|    DMFPEGVNVEFVEVVSETELHFRVWERGSGITQACGTGACAAVSTIVNGQAKKETDMTV
ref|NP_391097.1|       PRFPEGINVEFVETVNEQELHFRVWERGSGITQACGTGACAAVASVLNGVSKRNQDITV
ref|NP_244279.1|       EAFPDWVNVEFVQVVSPTEIHFRVWERGSGITQACGTGACAAVVASVLNGFTQKGQEVTV
RAAC01996              PDFPERVNVEFVSVLAPDEIDFRVYERGSGVTFACGTGACASVAALAKKGLVRN--RVTV
                       :  :***..:    *:.*:*** *  *******::.:      :*    .   .* ref|YP_001126997.1|    HLAGGDLTITWGHDGKVRMTGPAETVCTGVYY-
ref|YP_148810.1|       HLAGGDLTIVWGHDGRVRMTGPAETVCTGVYY-
ref|YP_001488092.1|    HLAGGDLIIRWKDNEHVLMTGPAETICDGTFY-
ref|NP_391097.1|       HLAGGDLVINWKDNGHVMMTGPAETVCEGVYF-
ref|NP_244279.1|       HLLGGDLTISWLENGDVLMTGAAETICEGTY--
RAAC01996              HLLGGDLDIEIRDDGHVWMTGEAHWVCEGTYYA
                       ** ****   *    .:  *  ***  *. :* *.:
```

FIG. 65

```
ref|NP_390723.1|        ------------------------------------------------NREFYFRRLHSL
ref|YP_001422141.1|     ------------------------------------------------NREFYFRRLHSL
ref|YP_080139.1|        ------------------------------------------------NREFVYRRLHSL
ref|ZP_01171785.1|      ------------------------------------------------NREFFNRRLHSL
ref|NP_243959.1|        ------------------------------------------------NREFFNRRLHSL
RAAC02025               MPNGWRRASRWPAVFCTCTAIPPRVHTVFSFGGLKGGTQVAVAQAAQHNREFFWRRLHTL
                                                                        **    **:* ref|NP_390723.1|        LGVIPVGIFLIQHLVVNQFAARGAEAFNSAAHFMDSLPFRYALEIFIIFLPLIYHAVYGV
ref|YP_001422141.1|     LGVIPVGIFLIQHLVVNQFAARGADAFNKAAGFMDSLPFRYALEIFIIFLPLIYHAVYGV
ref|YP_080139.1|        LGVIPVGIFLIQHLVVNHFAASGEEAFNNAAHFMENLPFRYALEIFVIFLPLIYHAVYGV
ref|ZP_01171785.1|      LGVIPVGLFLVQHLVVNHFATGGEESFNKAAHFMEQLPFRYVLETVVIFLPLLFHAIYGL
ref|NP_243959.1|        LGVIPIGIFLIQHFVVNHFATAGASAFNQAAHFMESLPFRYALEIFIIFIPILYHAIYGL
RAAC02025               SGVIPVGLFLLEHLFTNATALGGAAAFNEAVQAIQSLPLLHVIEFVFIFLPITYHGVFGL
                         ****:*:**::*:..*   *   *  :**.*.   ::.**: :..*  ..**:*: :*.::*:

ref|NP_390723.1|        YIAFTAKNNAGQYSYMRNWLFVLQRVTGIITLIFVSWHVWETRIAAQMGAEVNFDMMANI
ref|YP_001422141.1|     YIAFTAKNNAGHYSYFRNWMFVLQRVTGILTLIFVSWHVWQTRIAAQMGAEVNFDMMANI
ref|YP_080139.1|        YIAFTAKNNANRFGFFRNWMFVLQRITGIITLIFVSWHVWETRIAAQMGAEVNFDMMADI
ref|ZP_01171785.1|      YIAFTAKNNAGRFGFFRNWMFLLQRVSGVVTLIFITWHVWETRVAAAFGADVNFQMMENI
ref|NP_243959.1|        YIAFQAKNNTSHYGYFRNWMFLLQRISGVFLLIFIAWHVWETRIQAAFGAEVNYDMMADI
RAAC02025               YVAFVSGYNANRYSFSRNVMFVLQRVTGIITFVFIIFHLWTTRFS---GNAPSFDMVHEL
                        *:**  :  *:.::.: ** :*:***::*:.  ::*: :*:*  **.     *    .:*: ::

ref|NP_390723.1|        LSSPAMLGFYIVGVLSTIFHFSNGLWSFAVTWGITVTPRSQRISTYVTLIIFVALSYVGL
ref|YP_001422141.1|     LSSPFMLGFYIVGVLSVIFHFSNGLWSFAVTWGITVTPRSQRISTYVTLIIFLALSYVGL
ref|YP_080139.1|        LSSPIMLGFYIVGVLSTIFHFSNGLWSFAVTWGITVSPRSQRIATFVTMGVFVVLSYVGL
ref|ZP_01171785.1|      LSNPFMFWFYIVGVISTIFHFANGLWSFAVSWGITVTPRSQLISTYVTIAIFIALSIVGI
ref|NP_243959.1|        LSNPFMLVFYILGVVSATFHFANGLWSFFVSWGITVSPRSQQIMTYVTVAIFFALTFVGI
RAAC02025               VTDNAYFAFMIVGVIAATFHFSNGLWSFAIHWGITVGRRAQRITAWVTMIMFVVLAAVGV
                        ::.    :  *  *:**::. ***:******   :   ***** *:*  *  ::**:  :*..*: **:

ref|NP_390723.1|        KAIFAF----
ref|YP_001422141.1|     KAIFAF----
ref|YP_080139.1|        RAILAF----
ref|ZP_01171785.1|      RAITAF----
ref|NP_243959.1|        RAILAF----
RAAC02025               ASLIAFRMNV
                        ::  **
```

FIG. 66

```
ref|YP_149212.1|        ----SLRDIKTRINATKKTSQITKAMEMVSTSKLNRAEQNAKSFVPYMEKIQEVVANVAL
emb|CAA30654.1|         ----SLRDIKTRINATKKTSQITKAMEMVLTSKLNRAEKR-EIVRPYMEKIQEVVANVAL
ref|YP_001127389.1|     ----SLRDIKTRINSTKKTSQITKAMEMVSTSKLNRAEQNAKSFVPYMEKMQEVVANVAL
ref|YP_001488540.1|     ----SLRDIKSRITSTKKSSQITKAMQMVSAAKLNRAENNAKSFVPYMEKIQEVVAAIAT
pdb|2QE7|G              -----MREIKRRIRSVKNTRQITKAMKMVAAAKLRRAQETAENARPYADKIKEVISSIAA
RAAC00451               MAQNSMRDIRRRIKSVRNTAQITKAMEMVAAAKLRRVQDAVQQSKPYLSKMQEMLANLSL
                            :*:*: **  .::::  ******:**  ::**.*.:.  :    ** .*::*::: ::

ref|YP_149212.1|        GAGGASHPMLVSRPVKKTGYLVITSDRGLAGAYNSNVLRLVYQTIQKRHASPDEYAIIVI
emb|CAA30654.1|         AAR-ASHPMLVSRPVKKTGYLVITSDRGLAGAYNSNVLRLVYQTIQKRHASPDEYAIIVI
ref|YP_001127389.1|     GAGGASHPMLISRPVKKTGYLVITSDRGLAGAYNSNVLRTVYQTIQARHSSPDEYAIIVI
ref|YP_001488540.1|     GTS-AKHPMLLSRPVKKTGYLVITSDRGLAGPFNSSILRAAYQTIQSRHQSADEYAVIVI
pdb|2QE7|G              GTKDFSHPMLEARPVKKTGYMVITSDRGLAGPYNANILRLVSKTIEERHQSKDEYVIFAV
RAAC00451               SARLVKHPLLAVRPVRRIGYLVITADRGLAGPYNAQVVRAAMQEFGKRDKGS--YAIYTV
                          .:    .**:*  ***:: **:***:******.:*:..:*  . :  : *.  . *.: .:

ref|YP_149212.1|        GRVGLSFFRKRNMPVILDITRLPDQPSFADIKEIARKTVGLFADGTFDELYMYYNHYVSA
emb|CAA30654.1|         GRVGLSFFRKRNMPVILDITRLPDQPSFADIKEIARKTVGLFADGTFDELYMYYNHYVSA
ref|YP_001127389.1|     GRVGLNFFRKRNMPVILDITRLPDQPSFADIKEIANKAVGLFADGTFDELYMYYNHYVSA
ref|YP_001488540.1|     GKIGRDFFKKRGIPVISEVTGLGDEVAFADIKELASSTVQMFSDEAFDELYMFYNHFVSA
pdb|2QE7|G              GRKGRDFFKKRGYPVVEEVTGISDTPSLTEIQDIAQSAIGMFADETFDKLTIFYNEFVSP
RAAC00451               GKRGRNFFQRRGLPIAAEVVDLPDTPTYHSVRHLAENIVAAYEREEFDELYFIYNEFINA
                        *:  *  .**:**:*.  *:   ::.  :  *   :  .::..:*  . :   :    **:*  :  **.::..

ref|YP_149212.1|        IQQEVTERKLLPLTDLAE----NKQ--RTVYEFEPSQEEILDVLLPQYAESLIYGALLDA
emb|CAA30654.1|         IQQEVTERKLLPLTDLAE----NKQ--RTVYEFEPSQEEILDVLLPQYAESLIYGALLDA
ref|YP_001127389.1|     IQQDVTERKLLPLTDLAD----NQQ--RTMYEFEPSQEEILDVLLPQYAESLIYGALLDA
ref|YP_001488540.1|     ISQEVTEKKLLPLTDISAAATPNKR--SASYEFEPSEEEILEVLLPQYAESLIFGALLDS
pdb|2QE7|G              IVQRPVEKQLLPLTS-EEVLDGPVS----AYEYEPDSESVLEVLLPKYAETLIYSALLDA
RAAC00451               AVQRPVVRKVLPLASLGENVQGPRR----NYLFEPDEESVLAALLPRYAETLVYQAVLDA
                           *  .   :::***:.        *  :**..*.:*  .***:***:*::    *:**:

ref|YP_149212.1|        KASEHAARMTAMKNATDNANELIRTLTLSYNRARQAAITQEITEIVAGANALQ
emb|CAA30654.1|         KASEHAARMTAMKNATDNANELIRTLTLSYNRARQAAITQEITEIVAGANALQ
ref|YP_001127389.1|     KASEHAARMTAMKNATDNAHELIRTLTLSYNRARQASITQEITEIVAGANALQ
ref|YP_001488540.1|     KASEHAARMTAMKSATDNAKELIDSLTLSYNRARQAAITQEITEIVGGAAALE
pdb|2QE7|G              KASEFGARMTAMGNATDNATEMLETLTLQFNRARQAAITQEIAEIVAGANALR
RAAC00451               KASEHAARMNAMGNATDNALELIEKLTLSLNRARQAAITTQIAEIVGGAEALK
                        ****..***.**  *****  *:::  .***. *******:**  *:***.** **.
```

FIG. 67A

```
ref|YP_148525.1|          ---------------IIVVGGGLAGLMATIKIAEAGVPVELFSLVPVKRSHSVCAQGGIN
ref|YP_001126690.1|       ---------------IIVVGGGLAGLMATIKIAEAGVPVELFSLVPVKRSHSVCAQGGIN
ref|YP_092553.1|          ----------MSNSSIIVVGGGLAGLMATIKAAEAGTNVKLFSIVPVKRSHSVCAQGGIN
ref|NP_243958.1|          ---------------VIVVGGGLAGLMATIKVAEAGVPVELFSLVPVKRSHSVCAQGGIN
emb|CAA69872.1|           ----------MAKQSVIVVGGGLAGLMATIKSAEAGVPVHLFSLVPVKRSHSVCAQGGIN
RAAC02026                 MLTRAWEGIDVANTSIIVVGGGLAGLMTTIKVAEAGVPVKLFSLVPVKRSHSVCAQGGIN
                                         :********** * :*.*:************** ref|YP_148525.1|          GAVNTKGEGDSPWEHFDDTVYGGDFLANQPPVKAMCEAAPGIIYMLDRMGVMFNRTPEGL
ref|YP_001126690.1|       GAVNTKGEGDSPWEHFDDTVYGGDFLANQPPVKAMCEAAPGIIYMLDRMGVMFNRTPEGL
ref|YP_092553.1|          GAVNTKGEGDSPWEHFDDTVYGGDFLANQPPVKAMCEAAPSIIHLLDRMGVMFNRTPEGL
ref|NP_243958.1|          GAVNTKGEGDSPWEHFDDTVYGGDFLANQPPVKAMCDAAPGIIHLMDRMGVMFNRTAEGL
emb|CAA69872.1|           GAVNTKGEGDSPWEHFDDTVYGGDFLANQPPVKAMCEAAPGIIHLMDRMGVMFNRTPEGL
RAAC02026                 GAVNTKGEGDSPWEHFDDTIYGGDFLANQPPVLGMCEAAPAIIYLMDRMGVMFNRTPEGL
                          *****************:******** .:*.:::********.* ref|YP_148525.1|          LDFRRFGGTQHHRTAYAGATTGQQILYALDEQVRRHEVAGLVTKYEHWEFLGVVLDDEQI
ref|YP_001126690.1|       LDFRRFGGTQHHRTAYAGATTGQQILYALDEQVRRHEVAGLVTKYEHWEFLGVVLDDEQI
ref|YP_092553.1|          LDFRRFGGTQHHRTAYAGATTGQQLLYALDEQVRRFEVEGLVSKYEGWEFLGAVLDDDNT
ref|NP_243958.1|          LDFRRFGGTQHHRTAFAGATTGQQLLYALDEQVRRHETSGLVTKYEGWEFISAIIDDEGI
emb|CAA69872.1|           LDFRRFGGTKHHRTAFAGATTGQQLLYALDEQVRRHEAAGLVTKYENWEFLSVVLDDDGV
RAAC02026                 LDFRRFGGTKHHRTAFAGASTGQQLLYALDEQVRRYEVAGLVEKYEGWDFLGAVIDDEQI
                          *********:*****:***:****:*********:*. *** *** *:*::..:.:**:

ref|YP_148525.1|          CRGIVAQDLRSMEIKAFPADAVILATGGPGIIFGKSTNSVINTGSAASIAYQQGVYYANG
ref|YP_001126690.1|       CRGIVAQDLRSMEIKAFPADAVILATGGPGIIFGKSTNSVINTGSAASIAYQQGVYYANG
ref|YP_092553.1|          CRGIVAQNLTTMEIESFRSDAVIMATGGPGIIFGKSTNSMINTGSAASIVYQQGAYYANG
ref|NP_243958.1|          CRGITAQNLKTSEFQSFSADAVIMATGGPGIIFGKSTNSVINTGYAAAKLYEQGVYYANG
emb|CAA69872.1|           CRGITAQNLRSMEIVTFASDAVILATGGPGIIFGKTTNSVINTGTAASAVYQQGVHYANG
RAAC02026                 CRGIVAQDLRSMEIHYFRADAVVMCTGGNGLIFGKSTNSMINTGSAASELYQQGVKYANP
                          **.:* : *:  * :*::.* *:**:*:** :  *:. * ref|YP_148525.1|          EFIQIHPTAIPGDDKLRLMSESARGEGGRIWTYKDGKPWYFLEEKYPAYGNLVPRDIAAR
ref|YP_001126690.1|       EFIQIHPTAIPGDDKLRLMSESARGEGGRVWTYKDGKPWYFLEEKYPAYGNLVPRDIAAR
ref|YP_092553.1|          EFIQIHPTAIPGDDKLRLMSESARGEGGRVWTYKDGKPWYFLEEKYPAYGNLVPRDIATR
ref|NP_243958.1|          EFIQIHPTAIPGDDKLRLMSESARGEGGRVWTYKDGKPWYFLEEKYPAYGNLVPRDIATR
emb|CAA69872.1|           EFIQIHPTAIPGDDKLRLMSESARGEGGRIWTYKDGKPWYFLEEKYPAYGNLVPRDIATR
RAAC02026                 EMIQVHPTAIPGDDKLRLMSESARGEGGRVWTYKDGKPWYFLEEWYPEYGNLVPRDIATR
                          *::*******************:**********  **********:* ref|YP_148525.1|          EIFHVCVDLKLGINGENMVYLDLSHKDPKELDVKLGGIIEIYEKFMGEDPRKVPMKVFPA
ref|YP_001126690.1|       EIFHVCVDLKLGINGENMVYLDLSHKDPKELDVKLGGIIEIYEKFMGEDPRKVPMKVFPA
ref|YP_092553.1|          EIFDVCVRQKLGINGENMVYLDLSHKDPKELDIKLGGIIEIYEKFMGDDPRKLPMKIFPA
ref|NP_243958.1|          EIFHVCVDLKLGINGENMVYLDLSHKDPKELDIKLGGIIEIYEKFMGDDPRKVPMKIFPA
emb|CAA69872.1|           EIFHVCVDQKLGINGENMVYLDLSHKDPKELDVKLGGIIEIYEKFMGDDPRKIPMKIFPA
RAAC02026                 AIHKVCVEMGLGVDGQNMVYLDLTHIPADVLDRKLGNILDIYEKFVGDDPRKVPMKIFPA
                          *..* *  **::*:*******:*    *.*::*****:*:**:*:*** ref|YP_148525.1|          VHYSMGGLWVDYDQMTNIKGLFAAGECDYSIHGANRLGANSLLSAIYGGMVAGPNAVRYI
ref|YP_001126690.1|       VHYSMGGLWVDYDQMTNIKGLFAAGECDYSIHGANRLGANSLLSAIYGGMVAGPNAVRYI
ref|YP_092553.1|          VHYSMGGLWVDYDQMTNIPGLFAAGECDYSMHGGNRLGANSLLSAIYGGMVAGPKAVEYI
ref|NP_243958.1|          VHYSMGGMWIDYDQMTNIPGLFAAGECDYSQHGANRLGANSLLSAIFGGMVAGPKAVEYM
emb|CAA69872.1|           VHYSMGGMWVDYNQMTNIPGLFAAGECEYQYHGANRLGANSLVSAIYGGMVAGPKAVEYI
RAAC02026                 VHYSMGGLWVDYDQMTNIPGLFAAGEADYQYHGANRLGANSLVSCIYGGMIAGPNAVRWA
                          *******:*:**:***** ****** .*   *.********:*.:****:***:**: :
```

FIG. 67B

```
ref|YP_148525.1|        RGLEKSADAMPSTLYDSYVKREQEKWENILAMDGTENAYVLHKELGEWMTANVTIVRYND
ref|YP_001126690.1|     RGLEKSADALPSTLFDSYVKQEQEKWENILSMDGTENAYVLHKELGEWMTANVTIVRYND
ref|YP_092553.1|        QGLETSAEDLSSSVFDAYVKKEEEKWADIMKMDGNENAYVLHKELGEWMTDNVTVVRYND
ref|NP_243958.1|        NGLEKSAESMPSSLFEGELKKEQEKFDDILKMDGKENAYVLHKELGEWMTDNVTVVRYND
emb|CAA69872.1|         RGLKKSADDIRPDVFDRYRKAQEDKFEGLLNMNGSENAYVLHKELGEWMTDNMTVVRYND
RAAC02026               KNLRKSADSLPESLFEQYRRKYEQEFEEILKLDGDENPYQLHRELGKWMTDHVTVVRYND
                        ..*..**: :   :::    :    ::::   :: ::* **.* :*:*** ::*:***** ref|YP_148525.1|        RLLKTDEKIQELMERYKNISVTDTSRWSNQGATFIRQLYNMLQLARVITLGAYHRNESRG
ref|YP_001126690.1|     RLLKTDEKIQELMERYKNISVTDTAKWSNQGATFIRQLYNMLQLARVITLGAYNRNESRG
ref|YP_092553.1|        KLLKTDEKIQELAERYRNININDTAKWSNQGAVFTRQLHNMLQLARVITLGAYNRNESRG
ref|NP_243958.1|        KLLKTDEKIQELMERYKNIDINDTAKWSNQGASFTRQLDGMLKLARVITLGAYNRNESRG
emb|CAA69872.1|         RLEATINKIKELKERYKKININDTSRWNNAGAAFTRQLWNMLELAEAMTLGALLRNESRG
RAAC02026               KLKETDAKIQELQERWKRIKMSDTSRWENQVAQFTRHLKNMLIMARAITIGALMRNESRG
                        :*   *  : **::.*.:.**::*.*  *  *  *:* .** :*...:*: **** ref|YP_148525.1|        AHYKPEFPERNDEEWLKTTMARYTPD--GPAFHYEDVDVSLIKPRKRDYSKKKEEVK-
ref|YP_001126690.1|     AHYKPEFPERNDKEWLKTTMARYTPD--GPSFHYEDVDVSLIKPRKRDYSKKKEEVK-
ref|YP_092553.1|        AHYKPDFPERNDEEWLKTTMAKHAGDFEAPKFHYEDVDVSLIAPRKRDYSKKKVA---
ref|NP_243958.1|        AHYKPDFPERNDEEFLKTTKAKFNPETLAPEFEYEEVDVSLIEPRKRDYSQKKQ----
emb|CAA69872.1|         AHYKPDFPNRNDEEFLKTTKATWTPD--GPQISYEDVDVSLIPPRIRDYSKDK-----
RAAC02026               AHYKPEFPERDDENFLKTTIAEYTPD--GPKISYEDVDVSLIKPRKRNYAVSKEATKE
                        *****:**:*::**:****    *       :   .* :  **:*****  ** *:*:   .*
```

FIG. 68

```
ref|YP_080136.1|           ----------------KTIKFIITRQDTSDSNPYQEEFEIPYRPNMNVISALMEIRRNPV
ref|NP_243957.1|           -----------------VRFIITRQDDPDSSPYEEEFQVPYRQNMNVISALMEIRRNPV
ref|YP_148524.1|           ----------------KTVRLIITRQDRPDSAPYEEEFVIPYRPNMNVISALMEIRRNPV
ref|ZP_01697535.1|         ---------------KTVTFIIQRQDNPESEPYDETFEVPYRPNMNVISALMEIRRNPV
emb|CAA69873.1|            MAETEAAVKQK---SGKKVKFIITRQDDPNSQPYTEEFELDYRPNMNVISALMEIQRNPV
RAAC02027                  MSTTAEAVQQAQADSGRKVHLIIERQDTPDSEPYWEEFEVPYRPGMNVIACLMEIQRNPV
                             :** ***  .:* ** * * : ** .****:.****:****

ref|YP_080136.1|           NAKGEKTSPIAWDMNCLEEVCGACSMVINGKPRQSCTALIDQLEQPIRLEPMKTFPVVRD
ref|NP_243957.1|           NSKGETSTPVAWEMNCLEEVCGACSMVINGKPRQSCTALVDQLEQPIRLEPMKTFPVVRD
ref|YP_148524.1|           NAKGEKTTPVAWEMNCLEEVCGACSMVINGKPRQACAALIDKLEQPIRLEPMRTFPVIRD
ref|ZP_01697535.1|         NAKGEKTTPVVWEMNCLEEVCGACSMVINGKPRQACSALVDKLQQPIRLAPMRTFPVVRD
emb|CAA69873.1|            NQKGEHTAPVCWESNCLEEVCGACSMVINGKPRQACAALIDQLEQPVRIEPMRTFPVVRD
RAAC02027                  NKKGEPVAPVTWEMNCLEEVCGACTMVINNKPRQACSALVDKLQQPIRIRPMRTFPVVRD
                           * ***    :*: *: **********:****.****:*:**:*:*:**:*: **:****:**

ref|YP_080136.1|           LQVDRSRMFDSLKKVKAWVPIDGTYDLGPGPRMPERRRQWAYELSKCMTCGVCLEACPNV
ref|NP_243957.1|           LVIDRSRMFDSLKKVKAWIPIDGTYDLGPGPRMAESKRQWAYELSKCMTCGVCLEACPNV
ref|YP_148524.1|           LVIDRSRMFDALKRVKAWIPIDGTYDLGPGPRMPERKRQWAYELSKCMTCGVCLEACPNV
ref|ZP_01697535.1|         LQIDRGRMFDSLKKVKAWIPIDGTYDLGEGPRMPEKKRQWAYELAKCMTCGVCLEACPNV
emb|CAA69873.1|            LVIDRSRMFNALKRVKAWIPIDGTYDLGPGPRMPEKKRQWAYELSKCMTCGVCLEACPNV
RAAC02027                  LVVDRSRMFEALKRIKAWIPIDGTHDLGPGPRMSSEEQQIAYELSRCFTCGACVEACPNV
                           *  :.*::::*:***:* ****..  ..:* ****::*:***.*:****** ref|YP_080136.1|           NDKTNFMGPAPLSQVRLFNTHPTGAMNKSERLEAIMGDGGLAECGNSQNCVQSCPKGIPL
ref|NP_243957.1|           NSKSEFIGPAPLSQVRLFNAHPTGEMNKEERLQAIMGDGGLANCGNSQNCVQSCPKGIPL
ref|YP_148524.1|           NSKSNFIGPAPLSQVRLFNAHPTGAMHKAERLRAIMGDGGLANCGNSQNCVQSCPKGIPL
ref|ZP_01697535.1|         NSRSNFIGPAPLSQVRLFNAHPTGHMNRDERLEAIMGDGGLANCGNSQNCVQACPKGIPL
emb|CAA69873.1|            NEKTDFIGPAAISQVRLFNAHPTGAMNADERLDALMEDGGIEGCGNSQNCVRACPKGIPL
RAAC02027                  NDKTSFIGPFAISQARLFNMHPTGKMNKEERLQALMGEGGIFECGNAQNCVEVCPKGIPL
                           *.::.*: .:.** ** *: ***  *:* ::  *:**. ***** ref|YP_080136.1|           TTSIAALNRDTTVQA-------
ref|NP_243957.1|           TTSIAALNRSATLQS-------
ref|YP_148524.1|           TTSIAALNRETT----------
ref|ZP_01697535.1|         TTSIAALNRETT----------
emb|CAA69873.1|            TTSIAEMNRDTTKRMFKRWL--
RAAC02027                  TTSIAVMNREVTYRAIGAWLRK
                           ***** :**..*
```

FIG. 69

```
ref|YP_001124579.1|    -MNFDFTPEQEMLRQTVRKFVDKEIMPYIKEWDERGEFDRNIFKRLAELNLMGVCIPEQY
ref|YP_146298.1|       -MNFDFTPEQEMLRQTVRKFVDKEIMPYIKEWDERGEFDRNIFKRLAELNLMGVCIPEEY
ref|ZP_01697399.1|     -MHFELTEEQELLKKTVRNFVDKEIMPFIREWDENHHFETGLLKKLADLGLMGVCIPEKY
RAAC02040              MMDFSLSQEQMAVRDVVRKFVDEEILPHIREWDEKQHFEPGVLRRLAELGLMGVCIPEKY
ref|NP_691785.1|       -MDFHFSEEQQLLRKTVRDFTDKEIMPYISEWDRNGKFDPTLLNKLAELGLMGVCIPEQY
ref|ZP_01723229.1|     -MNFDMSTEHEMLRKTVRQFVDEEIIPYIAKWDAEGGFDAKIWSRLAELGLMGVCVPEQY
                        *.*  ::  *:    ::..**.*.*:**:*.*  :**  .   *:    :**:*.***:.* ref|YP_001124579.1|    GGMGMDYNSLAIVCEELERGDTAFRTAVSVHTGLNSLTLLQWGTEEQKQKYLIPQARGEK
ref|YP_146298.1|       GGMGMDYNSLAIVCEELERGDTAFRTAVSVHTGLNSLTLLQWGTEEQKQKYLVPQARGEK
ref|ZP_01697399.1|     GGSGMDYNALAIVCEELERGDTAFRTAVSVHTGLNSLTLLQWGTEAQKQKYLVPQAKGEK
RAAC02040              GGAGMDYNTLAIVCEELERGDIAFRTAVSVHTGLNSLTLLQWGTEEQKQKYLVPQARGEK
ref|NP_691785.1|       GGSGMDYNSLAIVCEELERGDTAFRTAVSVHTGLNSMTLLQWGNEQQKQKYLIPQAKGEK
ref|ZP_01723229.1|     GGSGMDYNSLAIVCEELERGDTAFRTAVSVHTGLNSMTLMQWGTEDQKQRYLIPQAKGVR
                       ** *****:*********** **************:***.*  ***:**:****:*  :

ref|YP_001124579.1|    IGAFGLTEPNAGSDVASIQTTAVRDGDDYILNGQKTWISLADIADHFLVFAYT-DKSKKH
ref|YP_146298.1|       IGAFGLTEPNAGSDVASIQTTAVRDGDDYILNGQKTWISLADIADHFLVFAYT-DKSKKH
ref|ZP_01697399.1|     IGAFGLTEPGAGSDVAGIGTTAEKDGDFYILNGQKTWISLCDVADHFLVFAYT-DKAKKH
RAAC02040              IGAFGLTEPNAGSDVAAMRTTAVRDGDSYILNGSKIWISLADVADHFLVFAYT-DRSKKH
ref|NP_691785.1|       IGAFGLTEPGAGSDVAALQSTAVKQGDHYILNGQKTWISLCDIADHFIVFAYTKDRSEKH
ref|ZP_01723229.1|     IGAFGLTEPGAGSDVAAMSTTAVRDGDHYVINGQKTWISLCDIADHFIIFAYT-DKSKRH
                       *******.**.: : ::.** *::**.* ****.*:**::** *:::* ref|YP_001124579.1|    RGISAFIVERTMPGFSSRPIKGKLGIRSGNTGELFFDNVRVPKENLLGEEGEGFKIAMSA
ref|YP_146298.1|       RGISAFIVERTMPGFSSRPIKGKLGIRSGNTGELFFDNVRVPKENLLGEEGEGFKIAMSA
ref|ZP_01697399.1|     HGISAFIVERTMPGFSSKAIKGKLGIRAGNTGELFFDNVRVPKENLLGEEGEGFKIAMSA
RAAC02040              HGITAFIVERGWEGFSTRSIKGKLGIRAGNTGELFFDHVRVPIENRLGEEGEGFKIAMSA
ref|NP_691785.1|       KGISAFIVERSWEGFSSKAIKGKHGIRSGNTGEIFFDHIKVPKENLLGKEGEGFKIAMSA
ref|ZP_01723229.1|     HGISAFIVERSMAGFTSKAIKGKYGIRAGNTGELFFEDLRVPVENRLGVEGEGFKIAMSA
                       ::**    :::.** *:***:..::   ******** ref|YP_001124579.1|    LDNGRFTVAAGAVGLIMACLEASVKYCHERKTFGKEIGRHQLVQQMIARMEAGLQISRLL
ref|YP_146298.1|       LDNGRFTVAAGAVGLIMACLEASVKYCHERKTFGKEIGRHQLVQQMIARMEAGLQISRLL
ref|ZP_01697399.1|     LDNGRFTVAAGACGLIQACLEASVKYCHERKTFGHEIGKHQLVQQMIAKMEAGYQMSRLL
RAAC02040              LDNGRFTVAAGACGCIAACLEASVKYCHERETFGQPIGKHQLVQQMIAKMAANLDISRLL
ref|NP_691785.1|       LDNGRFTVAAGAVGQIMACIEASVKYCHERETFGKEIGKHQLVQQMIAKMEAGYQMSKLL
ref|ZP_01723229.1|     LDNGRFTVAAGAVGLIQACLEASVKYCHERETFGKPIGEHQLVGQMIANMEAGYQMSRLL
                       ************ * *  **:***********.***:  **.****  **** . *:**

ref|YP_001124579.1|    VYKVGFLKNEGRRCTRETSLAKWIACDYANQAADDAVQVHGAYGYSNEYPVERYLRNSKA
ref|YP_146298.1|       VYKVGFLKNEGRRCTRETSLAKWIACDYANQAADDAVQIHGAYGYSNEYPVERYLRNSKA
ref|ZP_01697399.1|     VFRAGELKNQGKRNTRETSLAKWQACDFANEAANDAVQIHGAYGYSSEYPVERYLRNSKA
RAAC02040              VYRAGWLKNQGLPNTRETSLAKWVACDAAWEAASDAVQIHGAYGYSNEYPVERYLRNAKA
ref|NP_691785.1|       VYRAGELKNQGKRNTRETSLAKWQACDFANKAADDAVQIHGAYGYSDEYPVERFLRNSKA
ref|ZP_01723229.1|     VYRVGELKNKGVRNTRETSLAKWQACDFANKAADDAVQIHGAYGYSDEYPVARYLRNSKA
                       *::.* ***:*    ********* *** *  :**.****:******.**** *:***:**

ref|YP_001124579.1|    PVIYEGTREIHTIMQAEYVLGYRKDKPLRKTLPAWRPDE
ref|YP_146298.1|       PVIYEGTREIHTIMQAEYVLGYRQDKPLRKTLPAW----
ref|ZP_01697399.1|     PVIYEGTREIHTIMQAEYVLGYRTDKPLSKMLPAWPFTE
RAAC02040              PVIYEGTREIHTILQAEYALGYRRDKPLSRRLPAWPFEE
ref|NP_691785.1|       PVIYEGTREVHTIMQAEYVLGYREDKLLNQMLPAW----
ref|ZP_01723229.1|     PVIYEGTREIHTIMQADYVLGRRQDKPLANRLPKWPFEE
                       *********:***:**:*.** * **  .  ** *
```

FIG. 70A

```
ref|NP_391000.1|    ---------VEELVYRSNLIGSDRTVCNWGGGNTSMKTTEKDFRGREIEVMWVKGSGSDL
ref|YP_080655.1|    ---------LAELVYRSNLIGADRSVCNWGGGNTSMKTTEKDFRGRDIEVMWVKGSGSDL
ref|NP_242416.1|    -------TGLDELVYRSNLIGSDRAVCNWGGGNTSMKTVEKDFRGREIAVMWVKGSGSDL
ref|YP_173878.1|    ---------LDELVYRSNLIGADRSVCNWGGGNTSMKTTEIDFRGNEVDVMWVKGSGSDL
RAAC02181           MIVTQEITALQQLVDRSRRLGADRSICNWGGGNTSAKTTMLDHMGREIRVMWVKGSGSDL
ref|YP_644452.1|    ------LSPLEELAYRSNLLGSDRAVANYGGGNTSMKLRQEDHAGREIDVLWVKGSGSDL
                          :*. **. :*:**::.*:***** *    *. *.:: *:********* ref|NP_391000.1|    ATMKAHNFSGLKLDDIRPLIKRDQMPDEEMVDYLSHCMIDSKHPRPSIETLLHAFLPYKH
ref|YP_080655.1|    ATMSAGQFTGLRLDDIRPLMERSSMTDEEMTAYLSHCMMDGKHPRPSIETLLHAFLPFPH
ref|NP_242416.1|    ATMGAKNFTGLNLEDIRPLIEREEMSDEEMVEYLGHCMIDRNHPRPSIETLLHAFLPFKH
ref|YP_173878.1|    ATMGANNFTGLRLDDVLPLKEREAMTDEEMVAYLGHCLIDPRHPRPSIETLLHAFLPFKH
RAAC02181           AEATEKSFTALRLDEVLPLMERDAMTDEEMVDYLAHCMVEAKHPRSSIETLLHAFIPHTH
ref|YP_644452.1|    ATIRPEQFTGLRLAEILPLMERDSMTDEEMVSYLARCQLAPDMPRSSIETLLHAFIPHPH
                    *     .*:.*.* :: ** :*. *.**. .:*  :     .********:*. * ref|NP_391000.1|    VDHTHPDAIISICCCADNGKQIAEDIYGNRFVWVPYVRPGFTLSKMIAEGVANNPHAELVL
ref|YP_080655.1|    VDHTHPDAIISICCCDNGKEIAEEIYGSRFVWVPYVRPGFALSKMIAEGVKNNPNAELVL
ref|NP_242416.1|    VDHTHPDAIISICCADNGKEIAKNLFGDRFVWVPYVRPGFSLSKLIAEGVQKNPHAELVL
ref|YP_173878.1|    VDHTHPDAIISLCCAENGRELAEELFGDRFVWVPYIRPGFALSKMIAEQVDANPKAELVL
RAAC02181           VDHTHPDSIIAICTSTNGREVAKEIFGDRAVWVPYLRPGFALSKLVAEAVRANPQCECVL
ref|YP_644452.1|    VDHTHPDAVNMLCCAANGEELARECFGDEAVWIPYLRPGFDLSKKVAAAVRGNPRARFVL
                    *******::   :* . **.::*.: :*.. **:**:**** ***  :*   *  **... **

ref|NP_391000.1|    MEKHGLVTWGETSETCYQKTISIIQEAEQYINDRINQHEVFGGKRYQPLPEDKRKQILAG
ref|YP_080655.1|    MEKHGLVTWGETSKESYDQTIAVIREAEAYIKRSEDHQPFGGQMVEPLAPEERKRILAD
ref|NP_242416.1|    MEKHGLVVWGETAKESYDRTISVINEAEAYIRSRINESVIFGGGKYTALAKEERMSMLAN
ref|YP_173878.1|    MEKHGLVVWGETAKESYDRTISVINEAEQFIEKKRGKNAPFGGAATAGLKKEERQALLAN
RAAC02181           MEKHGLITWGETSEACYANTVRIIGEAAEYLEAKQRGRVAFGGVKHPALPQEERRRIAVQ
ref|YP_644452.1|    LAKHGLVTWGETAEESYARTVEAVNRAAEFVFRRASRTEAFGGRRLDPPPEEERRRLLAA
                    : ****:.****:: .* .*:  : .*  ::   :      ***      ::* : .

ref|NP_391000.1|    IMPVIRGAVSEE-KKMILSYDDHDDVLEFVNSVQAPALSQIGAACPDHLVHTKRVPLYID
ref|YP_080655.1|    ILPVIRGAVSGE-KRMLVTWCDADDVLEFANSRRAPSLSQVGAACPDHLVHTKRVPAYIP
ref|NP_242416.1|    VMPVIRGAVSDE-KKMIVTFDDGDDVLEFVNSVDAARLSQVGAACPDHLVHTKMKPLFVK
ref|YP_173878.1|    IMPVLRGAVAHNGRNMIVTYDDSDPILEFVNSKEAKELSQIGAACPDHLVHTKRLPLFID
RAAC02181           ILPFVRGIVSER-QGAILSFDDSPEFLEFAGSHDAPSLSQVGAACPDHLVHTKRRPLFVD
ref|YP_644452.1|    VLPALRGELSSRGGPKILRADTSPDVTGFVCGRDSGELSQVGAACPDHLVHTKVRPLWVD
                    ::* :** ::  .    ::         . *.. :  ***:**********   *  ::

ref|NP_391000.1|    WNPETQDVHKLADLIKSGVETFTSEYQAYFTRNQQ----DGDQIFESAPRVILIPGIGMV
ref|YP_080655.1|    WNPAEQDTEALVDRIKTEIAGFKESYAAYFQRNRH----EGDEMFEPAPRVMLIPGIGMV
ref|NP_242416.1|    WDPSMNDINQLIAAIKDGISSFKEEYKSYFERNKN----EGDVMFEPAPRVILIPGIGMV
ref|YP_173878.1|    WVPDASDEEGLKQAVLNGIAAYKEDYIRYFERNRR----EGDTMFEPSPRVLLIPGIGLI
RAAC02181           WSPSE-GVDALKEKLKAGLTAYRDDYAYYERNVD----LDVPMHDPFPRILLIPGLGVI
ref|YP_644452.1|    FDPASEGVDALERRLREGVRRYRERYEEYFRRNRARVGRGDEQMHDPNPRVVLISGVGLV
                    : *    .. *    :    : .*  *: **         . :.:. **::**.*:*::

ref|NP_391000.1|    NTGKSYAMSKVSGALYRRAIAVMKGATALGQFVSLHENESYHVEYWPLELYKLTLAPPEA
ref|YP_080655.1|    TAGKSLAMAKVSRDLYRRAIAVMKGTEVLGNFVSLNEEESYNVEYWPLELYKLTLAPPEA
ref|NP_242416.1|    NTGKNVTMARVSGALYHRAIAVMKGATALGTFVSLNENESYNIEYWPLELYKLSLAPAEA
ref|YP_173878.1|    SSGKAVENAKVSRALYERAIAVMRGTNALGSFVSLNEAESYEIEYWPLELYKLSLAPKEA
RAAC02181           GTGKNKKMANIALDLYRRAIEVMRGATAIGEFVSLDEKESFDVEYWPLELYKLTLAPPEK
ref|YP_644452.1|    AAGRDLKAATLARDLYHRAISVIRGASSVDRFVSLDEEESYRVEYWPLELYKLTLAPPPK
                    :*:      : :: **.***  *:::*.  :. ****.*  **:  :***********:***
```

FIG. 70B

```
ref|NP_391000.1|    EFSRKVALITGGAGGIGSAACRRFAAEGGHVIVADLNIEGAQKIAGEINDAYGKGRAMAV
ref|YP_080655.1|    EFSRKIAFVTGGAGGIGSEACRRLALEGAHVVVADINIEGAEKTAAEINDQYGAERAYAV
ref|NP_242416.1|    EFSRKVAFVTGGAGGIGSETCRQFVAEGAHVVVADLNLEGAEKVVSEINEQYGTDRALAV
ref|YP_173878.1|    TFSRKVAFVTGGAGGIGSETSRQFAAQGAHVVLADLNLERAEEVAAEINGQFGAGRALAL
RAAC02181           ELSRKVAYITGGAGGIGSATARRLAEEGAHVVIADLAADAARRLAEELCADHGPGTAIGV
ref|YP_644452.1|    ELAGRVALVTGGAGGIGSAVAERLHEAGACVVVADLDGEGASEVASRL----GP-EGLAV
                    ::  ::* :********  ..::   *. *::**:  : *. ...:    *    ..:

ref|NP_391000.1|    KMDVTKEEDVQSAFERAALAYGGIDIVVNNAGLATSSPFDETSLKEWNLNMNVLGTGYFL
ref|YP_080655.1|    RMDVTKEEEVQTAFEEIALKYGGIDILVNNAGLATSSPLDETTLEEWNLNMNVLGTGYFL
ref|NP_242416.1|    KMDVTSEEQVQAAFKQASLTYGGIDIVVNNAGLATSSPFDETTLDEWNLNMNVLGTGYFL
ref|YP_173878.1|    KMDVTDEQAVKQAFADVARTYGGVDIVVNNAGLATSSPFDETTLQEWQLNLDVLATGYFL
RAAC02181           ALDVTQEDAVVRSIEEAILAYGGIDLFVSNAGLASSAPVTETSLAEWNKNVAVLGTGYFL
ref|YP_644452.1|    RADVTSEEEVARAFRAAALAYGGVDVVISNAGLASSAPLEETSLDLWRRNHAVLSEGYFL
                     ***.*: *   ::      ***:*:.:.*****:*:*. **:*   *. **. ****

ref|NP_391000.1|    VAREAFKQMKHQNRGGSMVFVGSKNSVYAGKNASAYSSVKALETHLARCIAAEGGEFGIR
ref|YP_080655.1|    VAREAFKQMKKQGSGGSMVFVGSKNSVYAGKNASAYSSAKALEVHLARCIAAEGGPYGIR
ref|NP_242416.1|    VAREAFKQMKVQGTGGNMVFIGSKNSVYAGKNATAYSSAKALETHLARCIAAEGGPFGIR
ref|YP_173878.1|    VARQAFAQMKEQGTGGSMVFIGSKNSVYAGKNASAYSAAKAMEAHLARCIAAEGGTYGIR
RAAC02181           TSREAFRVMVEQGRGGAVVFVTSKNAVYAGKDASAYSAAKAMENHLARCLAVEGGPHGIR
ref|YP_644452.1|    VSREAFALLKRQGIGGSIVFVGSKNALAAGRNAAAYSSAKAAELHLARCLAEEGGPHGIR
                     .:*:**   : *.  :: *:: ::*:*:. * *****:* * .* ref|NP_391000.1|    VNSVLPDAVLQGSAIWGSSWREERAAAYGIEPDQLEEHYRKRTALLVNIYPEDIAEAIAF
ref|YP_080655.1|    ANSVLPDAVLQGSAIWDSKWREERAAAYGIEPDRLEEHYRKRTALSVNIYPADIAEAIAY
ref|NP_242416.1|    VNSVLPDAVLQGSAIWGSRWRQERATAYGIEPDQLEEHYRKRTTLLVNVYPGDIAAAILF
ref|YP_173878.1|    VNTVLPDAVLQGSAIWDSAWREERAAAYGIAADELEDHYKKRTTLGVHIFPADIAEAVLF
RAAC02181           VNIVMPDAVLQGSNIWNSAWREERARAYGIAPEELEDYYRRRTILGVNILPEDIAEAILF
ref|YP_644452.1|    VNTVNPDAVLQGSRIWDSAWREERARAYGIEPGELEEYYRNRTALKTNVYPEDVAEAVLH
                    .* * ******** **.* **:*** ****   .**::*:.** * .:: * *:* *: .

ref|NP_391000.1|    FAS-SKAEKTTGCMITVDGGVPAAFTR
ref|YP_080655.1|    FAS-EKTAKTTGCMLTVDGGVPAAFSR
ref|NP_242416.1|    FAS-SKAEKTTGCMLTVDGGVPAAFTR
ref|YP_173878.1|    FAS-SKSEKTTGCMLTVDGGVPAAFPR
RAAC02181           FCS-PRSAKTTGCMLTVDGGVAAAFPR
ref|YP_644452.1|    FASGRRSGKSTGNVLNVDGGVREAYPR
                    *.*   ::  :***  ::.***** *:.*
```

FIG. 71

```
ref|YP_001487576.1|      -FEYHCQTNIMMGNGQSKEIGSIVEDLVLPG--AKVMIVTDSGVRNAGLVQPIEAYLQEA
RAAC02222                MFSYSIQTHIEFGDG---AVEHLPEHLVARGFGRRLLIVTDPGLVRAGVADRIAGLLSRA
ref|ZP_02211990.1|       LFSFELPTKIIYGAN---CLDNLCVEL-KENKGKKPIIITDKGVENAGILKKITDLLDKD
ref|NP_744947.1|         -FKFLLPSKIVMEPG---LRERTGEHLRQLGLAR-VLIVTDAGVKAAGLLDSVYASLDKA
ref|YP_001343716.1|      ---YFLPTRNVFGEN---AVEEVGTLMKSLG-GNNPLIVTDAFLAKNGMADQLAAVLSNA
ref|YP_633768.1|         -------TRIVFGAG---ALLRLPAQAQRLGIQRPLL-VTDAGVVKAGLAARVADVLNTA
                                 :.       .  :**    :   *:    :    *.

ref|YP_001487576.1|      GYSVFVFDQVSPNPRDNECLAGAELFRKEQASAVIAIGGGSPMDTAKAIALLGPN-GGIP
RAAC02222                GFVPRVFAEVRPNPDETVCLAGRGAFFEHRADGVVAVGGGSSLDAGKAIALLARQ-GGTP
ref|ZP_02211990.1|       DFPYVIYAGVEANPKDVNVEEGAKIARENDCDCIIAVGGGSPIDCAKSVGVLLAHNDTEI
ref|NP_744947.1|         GIAYEEVADIKANPRSDDINHTAQRYRGTGIDGLLAVGGGSAMDAAKAISLLLTH-DGRI
ref|YP_001343716.1|      GLKPVIFGGAEPNPTDKNVEEGIVFYNEHGCDSIISLGGGSSHDCAKGIGLIASN-GGRI
ref|YP_633768.1|         GLACEVFDRVEPNPTERDVFAGLEAYRSHSCDGIVALGGGSALDAGKLIQLLTTH-EPPL
                          .     **  .            . :::*:****. *  .* :  ::      :

ref|YP_001487576.1|      EDYKSGKK----AYANLSPLICIPTTAGTGSEVTRSSVITLAASHKKITLKHALLRPTIA
RAAC02222                SDYALNRR----PYGPPAPVCAVPTTAGTGSEVTRSAVITERGTHRKLTLKHEYLRPPLA
ref|ZP_02211990.1|       KKYEGKTA----ATKPLPLFITIPTTSGTGSEITFSSVITDTKNKYKMTVKSKYTAAKVA
ref|NP_744947.1|         EDYEGSFT----LTHAIPPIVAIPTTAGTGSEVTCFSVITDTARHFKMNVLDYRIGPVLA
ref|YP_001343716.1|      QDYEGVDR----SHNAMVPLMAVNTTAGTASEITRFCIITDTARKVKMAIVDWRITPQIA
ref|YP_633768.1|         SRYDDAKGGDQYVRDDLPPLIAIPTTAGTGSEVGRSGVVTLEDTGRKTVIFSPYLLPRAA
                         . *      .   :  :.**:    ::*      *  :              * ref|YP_001487576.1|      ILDPALTLTVPKSITAATGVDALVHAIEGYSCKVTNPISKAMGASAMETIVKYLPAAYKD
RAAC02222                VCDPTLTASLPPDVTAHTGVDALVHAIEGSTCKGAHPIARAYAREALGLIYRALPKAIKA
ref|ZP_02211990.1|       ICDPVLTLSVPPAVTAATGMDALTHAIEAYTATCSEPIADAVSLYAIELIYNNLKTAVFE
ref|NP_744947.1|         LLDSHITDTLPPSIAAATGMDALTHAIEAYTCRVANPISDGLALHAIRLISQHLKAAVQE
ref|YP_001343716.1|      VNDPLLMKGMPPSLTAATGMDALTHAIEAYVSTAANPLTDAAALMAITMIQQYLPKAVAN
ref|YP_633768.1|         ICDPELTLGLPGITAATGMDAFTHCLEAYLANGFHPLADAVAIDGIYRVGRSLETAVRD
                         : *. :     :*   ::* ::.*.:*.     .*::     .:   .*   * ref|YP_001487576.1|      GSDLEARYKM-QEGSLLAGLCFGSADVAAVHCLAEALGSLYDTPHGIANAVFLPYVMQFN
RAAC02222                G-DPASRHDM-LLGSLLAGLAFGSTDVASVHCLAEALGSLYETPHGLANAVMLLPTLRYN
ref|ZP_02211990.1|       GDNLQARSAM-LMGSMLAGIGFSHSDVASVHCISEALGGMFDLSHGVCNAVLLPHVMEYN
ref|NP_744947.1|         PDNQAAREQM-LVASLIAGMAFGNADVGSVHCISEAIGGMYDTPHGVGNAIFLPFVFGHN
ref|YP_001343716.1|      GDYMKARDKM-AYAQYLAGIAFNNASLGYVHAMAHQLGGFYNLPHGVCNAILLPYVEEFN
ref|YP_633768.1|         GKDLAARTDM-MVAAMEGAMAFQKG-LGACHALAHALTPVSNVHHGLANAIVLPVVMEFN
                          :* *       .   ..: *    :.  *.::. . : .  : :.*   . .* ref|YP_001487576.1|      AAENKVLHAELAKIMSFADKTDSDDVAIQKLIDGMYTFTK--NLGIP-VLKDLSYVKEED
RAAC02222                LPCAVEPYAWIARAMGLAREEDGAERAAEALLAGLRTWLE--SLDIP-KLRDLPGVRPSD
ref|ZP_02211990.1|       KDYCVAKYARVAKAM-GFEFK-SDDEGADLAVKAVQQLAL--DVKLP-LFSEL-NVEPKD
ref|NP_744947.1|         RDADIVRHAQVAYAL-GIDPTLSPVDAAEAAVGHLFQMSK--DLGIP-RFAEVKGVREED
ref|YP_001343716.1|      LIGNLNRFRDIAKAMGENIDGLCTDDAALKAIGAIRRLSK--QVGIP-ANLQLLGVKPED
ref|YP_633768.1|         RAVCTARLARVAVAL-GDTTQAREEVLAGNAIDRVRKL-N--AAVGIPSRLRD-AGVQEKD
                              :*    :          :          :  :*   :   *. .* ref|YP_001487576.1|      FEKMAELAEQNGSTSSNVRTVTKADYLDILKAAF--
RAAC02222                FDRLAELAYENTSTPSNPRPMAVSDYRAVLEMAYAD
ref|ZP_02211990.1|       FDILADKSAINISTESNPRPMSKEDYLNVLNNAY--
ref|NP_744947.1|         FPTIAEKSKQNFSDASNAKAMSVEAYHDIITTAY--
ref|YP_001343716.1|      FDVMAENAMKDVCMLTNPRKATKQQVIEIFQRAY--
ref|YP_633768.1|         LERIAEKAFQDASHLSNPRKVSQADLLALAREAY--
                         :  :*: :   :  . :* :   :       *:
```

FIG. 72A

```
ref|ZP_01869175.1|    ------------------------------------------------------NNFTFNL
ref|ZP_00989613.1|    ------------------------------------------------------NNFNFQL
ref|YP_146053.1|      ----------------------------------------------------------FWL
RAAC02274             MGRTRSTNTRSSSTYTRRSCTSSKTAIGIPLCCPTGPDAIDFCEVVRRMPYIRSGFQFMA
ref|YP_001276414.1|   --------------------------------------------------------FEYHM
ref|YP_001211401.1|   ----------------------------------------------------------FWT
                                                                                :

ref|ZP_01869175.1|    RTVVHSGASSIEA---IPTLFKAKGAQRVLLVSDKGLESLGFVERLASLFS--------T
ref|ZP_00989613.1|    KTIVHAQENGIEN---IPSLFGRLGAQRVVLFSDKGLESLGFVEQFSALFVNEKVNQPGY
ref|YP_146053.1|      RTAIYTGSNTRAL---VPDLFRGLGAKRVLLLSDRGLEQAGVVEKVASLFDLTT-----H
RAAC02274             RTTITNGVGSRVF---LPETVRGLGGKRAFVVTDPGIVRAGLLDKILELFDLVP------
ref|YP_001276414.1|   RTRLMYKIGLARD--FANEVVQ-LGVQRALLVADPGVVQAGLLDRVREGLE---------
ref|YP_001211401.1|   SGTIITGRGSLKR--IADEAKG-LGATRVLIVTDPVLLKTGLIERVKEA--LAP------
                                   :  .       *  *..:.:*    :    *.::::.

ref|ZP_01869175.1|    EEKVKLAGIYTDIEADASCLDINRALEFAKQVNADSILALGGGSVIDASKGIKYGLEHK-
ref|ZP_00989613.1|    EQAVQLVGVYTDIAPDATCDNINAAIEFANSVNADAILSVGGGSVIDASKGVKYAFHKQ-
ref|YP_146053.1|      GVGPELVGIFLDIRQDAESECVNEAVRYARAVGADALLAVGGGSVLDTAKGVKYALFKG-
RAAC02274             -TPVTIAGVFDRVEQDAKAHIINEAARAYRECAADSLIALGGGSVLDTVKGIKWMVSRG-
ref|YP_001276414.1|   -GSITVAGAFTDVPPDSSVATVEQGAAVARDAGADVLIAVGGGSAIDTAKAMRILLTEG-
ref|YP_001211401.1|   -AGLE-TGIFSGVEPEPRLQIVTECLKAVKEGGYDLIVAVGGGSSMDVSKAASVLMTN--
                          .*  :   : :.     :       .      * ::::**** :*. *.    . .

ref|ZP_01869175.1|    ---LDDIRDAIQGGGRLEVGPD---VKPFSIPHIGVPTTAGTGAEASPIAVFYNEREQVK
ref|ZP_00989613.1|    ---IDDIRTVIAGGGHIDVWPN---NEDIRVPHIAVPTTAGTGAEASPIAVFYNEHENIK
ref|YP_146053.1|      ---LRDIKEAIPGGLRYESFPQ---AQFMPIPHIAIPTTAGTGSEVSPIAVIYNEELRLK
RAAC02274             ---LTDIRPALIGN-VLEMWPE---AQPIFIPHVALPTTAGTGAEASPIAVVFHDDLGVK
ref|YP_001276414.1|   -----GTLYDYQGA---NLL-----TRPLF-PMIAIPTTAGTGSEVTPVAVIRDEQAEQK
ref|YP_001211401.1|   ----PGTINDYLGV---NLI-----PRP-GIPVIAVPTTAGTGSEVTPIAILSDVEEQLK
                              .    *    :       . *  :.:*******:*.:*:*:.   * ref|ZP_01869175.1|    ASLVVSGLECDIAVLDPELTVSLPAALTVSTGMDALTHAIEALASPLSNTFTDAYATQAC
ref|ZP_00989613.1|    ASLVASGLEADIAILDPTVTTKLPAHLTRSTAMDALTHAVEAIVSPMSNAFTDAYGIQAA
ref|YP_146053.1|      TNIINPFINADVAVLDPDLTVGLPPKVTAFTGMDALTHAIEALASPMATALTDACALQAI
RAAC02274             VNLINPFINADIAILDPELTVGLPPSITAFTGFDALTHAIEGFFSPQANPFTDAYAIQSA
ref|YP_001276414.1|   LFFLSPYLGPELAILDPEMTRTLPPRLTAATGMDALSHAIETFVGVGANPITDSLAIQAI
ref|YP_001211401.1|   KGVVSPYLLPRVAIVDPELTVTMPPAITAATGMDALTHAVESYISVNATPITDILALEAI
                       .:  .  :     :*::** :*   :*. :*   *.:***:**:*       . :::**   . ::

ref|ZP_01869175.1|    RLILNNLPQVLQSPQNVAARCELLQASTMAISAFYSS----LGGIPIHNCAHAFGAVAHI
ref|ZP_00989613.1|    KLIIENLPLALKEPENLTARGNLLQASTMAISAFYSS----LGGIPIHNCAHAFGAISHI
ref|YP_146053.1|      RLIRDYLPEAVRDGGDIRARLEMLHASLLGITAFSFA----LNAIPVHNFAHAYGAMFRI
RAAC02274             RMIFENLPKAVANGQDLTARANMLMASTMAIISFSLA----LNAIPVHNMAHAFGAKFGI
ref|YP_001276414.1|   DMISNYLRAATHNGEDMEARGNMLIAAAIAGIAFSTT-GIGVNTGIIHAASHTVGAAYHV
ref|YP_001211401.1|   RLIALNLRTAVANGQDIEARSNMSASLLAGIAFANA------GVGAVHALAYPLGAQFHV
                      :*   *     .   .  ::  **    :: *::   :*    :   . :* ::. **  :

ref|ZP_01869175.1|    PHGDANSVLLPVVIEALPEFYLPSINKLAAVFGI-SPSLTDA-EKHQEVVHSLRAFQALV
ref|ZP_00989613.1|    PHGDANTVLVPVVIEALPEFYMPNAAKLAQAFSV-DTTGTDE-MVYQRVLDFLNNFQTSV
ref|YP_146053.1|      PHGLANAVFLPVVMEAIPELYLPKAKLLAQALGIYDHGQGNE-ALLVKSIERIRQLRDDI
RAAC02274             PHGLANAVLLPNVMAAMPAFYRARIREFMAAIGLDAPSDPD--AALESFIQRIRDLRQQV
ref|YP_001276414.1|   HHGTANSILLPHGMRFNAPVVPNRMVRIARAMGVNAGGRSEEDVIADG-IAAVAKLAADC
ref|YP_001211401.1|   PHGVANAVLLPYVMESNLLGALPRFKTMALAMGEKVEDLSDR-LAADKFNEAIKLLAADI
                      ** **::::*     :                :   ..:               :   : :
```

FIG. 72B

```
ref|ZP_01869175.1|      NATQSFAKWNLDDNKKAQIVSGIEKDISFQFY---------------
ref|ZP_00989613.1|      GAMKRFSSWDFDAQEKSNIAEAIEKDICFQFYPISKQTIETI------
ref|YP_146053.1|        GLPADFADYPMTEEQFAATIPAVASDPAAISFPMPPELIRAIGERV--
RAAC02274               GLPATFADYQLDKRQLGKMVDLVHADPSGVVYRLPDAIIQRVTREVAS
ref|YP_001276414.1|     GLPTRLRDVGVPEDALPALAEGTLMDGAIMSNPRPVEYEDALAILR--
ref|YP_001211401.1|     RIP---------------------------------------------
```

FIG. 73A

```
ref|YP_001636911.1|    -------LPHYDLYIDGAWQPAENGQTFTVYDPATSQPIATCASATHSDVDRAVRAARAA
ref|ZP_01514632.1|     -------LPHYDLYINGAWQPASSKQTFTVFDPANGQPLATCASASPTDVDRAIAAARSA
ref|YP_001274650.1|    -------LPCYGLYIDGSWVDAEGGTM-PVNEPALGRPMARVARGSAADVDRAVAAAREA
ref|YP_001546552.1|    -------LRSFGLYIDGAWVAASDAASETLYNPATGEPVAQVARATIHDIDRAVGAARKS
ref|YP_146052.1|       ---THVQVHHFPLFIDGQWQPATSGETFHVYNPATGEVVATVAKATADDVDRAVKAARKA
RAAC02275              MVMTSVRLPEYGMFIDGEYTPAESGEMFEVVNPATGQPCARVAKSDARDVDRAVRSARRA
                              :  ::*:*  :   *  .   :**  ..   * * .  *:***: :**  :

ref|YP_001636911.1|    FDHGPWPHTSPAQRAEILHAIADALEARNFELAEIESRDAGVPIRKTTYNDITLGLEILR
ref|ZP_01514632.1|     FDHGPWPHTSPARRAEILHALADALEARNFELAEIESRNAGVPLRKTTYNDITLGIEILR
ref|YP_001274650.1|    FDRGPWPHTPGHERARVLNAIADLIEEHTAEFAELETRNLGAPLRKTTFVDIPWSVEHLR
ref|YP_001546552.1|    FDIGSWAQMRPVDRAKTIEAIADLLEENTDELAELETLNGGATLRKSSWLDIPVGIEHLR
ref|YP_146052.1|       FDETDWKAMKPKERARVLNAIAQAIAANAQELAYLEAISSGGTIRRISSIDILQTVDLFQ
RAAC02275              FESGEWSRAKPHERAQVLLRFADEIVAHAQEIAFLEILTSGATVRRVSNADLLLIVDLLQ
                       *:    *          **. : :*:  :   *:* :*   * ..:*:  *:  :: ::

ref|YP_001636911.1|    GCAEMARKHPY-EPLPWNDLPSVSWNFVWREPIGVCAQIIPWNYAFCMAAWKLGPALATG
ref|ZP_01514632.1|     GCAEMARKHPY-EPLPWNDLPSVSWNFVWREPIGVCAQIIPWNYAFCMAAWKLGPALATG
ref|YP_001274650.1|    VFAELATIHPY-EPLPWTDVPSVSWNFVWREPIGVCGQIIPWNYPLLMTIWKIAPALAAG
ref|YP_001546552.1|    YFADLARQHPM-QTLPYIDFPSPSANAVWREPIGVCGQIIPWNYPFLMAIWKIGPALAAG
ref|YP_146052.1|       TMANIVQEYPFSETLPIPPFPGPAHNFVWREPIGVCAAITPWNLPLMIASWKIAPALAAG
RAAC02275              QTARFAQAYEYAKTLPLRPFPQPSHNQVWREPVGVCAGITAWNYPLILAMWKLAPALAMG
                        * :.  :    :.**    .* : * ***:*. *  .: :: :.**** * ref|YP_001636911.1|    NTVVFKPSSLAPLSTLAIFQTIHDLNLLPKGVINLVLGPGGDVGEYLVTHPAVDKVAFTG
ref|ZP_01514632.1|     NTVVFKPSSLAPLSTLAIIQAIHELNLLPKGVVNLVLGPGGEVGEYLVAHPDVDKVAFTG
ref|YP_001274650.1|    NTIVLKPASYTPLTALRLTQLIHEAGLLPRGVLNVVTGPGAEVGDALARHPGVDKVSFTG
ref|YP_001546552.1|    NSLVLKPASLTPVTALRMAELIHEADLLPHGVFNVVTGPGGLVGERLTSHPAVDKIAFTG
ref|YP_146052.1|       NTIVVKPASYTPLSTLKLAEIISSF-VPP-GVINVVAGPGADVGEALVRHPQVDKVAFTG
RAAC02275              NSIVLKPASNTPLSTLKLAELAAKA-GLPKGVFNVVTGPGSSVGEALVTHPEVDKIAFTG
                       *::*.**:*  :*:::*   :  :         * **.:* *. : *.  *:.*** ref|YP_001636911.1|    STEVGRKIMALAAPHIKRVTLELGGKNAMLILPDADLDLVVDGVLWGAFYHSGQLCEAGS
ref|ZP_01514632.1|     STEVGRKIMALAAPHIKRVTLELGGKNAMIILPDADLDLVVDGVLWGAFYHSGQLCEAGS
ref|YP_001274650.1|    STETGRHIMRLASDTIKRLTLELGGKSPSLVMPDADLELATDGVLFGVFFNGGQSCEAGT
ref|YP_001546552.1|    STEVGRRIAEVAGRNLVRNADLLAVDGAIWAAFMHSGQSCEAGT
ref|YP_146052.1|       STEVGRRIMALAAETVKNVTLELGGKSPNILLEDADLDLAVPGSLFGVFLHSGQLCESGT
RAAC02275              STEVGKRIMQLAAQGVKRVTLELGGKSPAIVLPDADLDLAIPGILFGVFLHAGQVCECGT
                       ***.*::*    :*.   :*.:******  .   :::  :***:*.    *  :..** **.*:

ref|YP_001636911.1|    RLLVPHALHDTLVERLVERVRGMRIGDPMDLETDIGPLISERQREKVEYYIAVGREEGAT
ref|ZP_01514632.1|     RLLVPHALHDTLVSRLVERVRTMRIGDPMDLETDIGPLISEQQRAKVERYIAIGREEGAT
ref|YP_001274650.1|    RCLVPESLHDEFLERLVTRARSLRIGDPLDLETDLGPLVSEAQCRIVEEYIEVGKNEGAR
ref|YP_001546552.1|    RLLLPDSLHDQFVERMVARVEQLVLGDPLDLTTDLGPLVSAAQKRAVEAYIELGIQEGAT
ref|YP_146052.1|       RLFVPDRLHDEVVERLVALTKTLQIGHPLDPATDVGPVISKRQKETVLSYIEAGKQEGAT
RAAC02275              RVIVHEDIYEEVVNRLAEMASQIKLGNPLDDKVGMGPIISESQMNTILSYIESGKAEGAR
                       *  ::   .   :::   ..:*:.   .     :   :*.*:*  ..:**::   *   :   **   *   *** ref|YP_001636911.1|    VVIGGGRPIGEAFANGHYVEPTIFTGVRPEMRIAREEIFGPVLSVIAYDEIGEAIRIAND
ref|ZP_01514632.1|     VVIGGRRPPDEARAKGYYVEPTIFTGVRPEMRIAREEIFGPVLAVIAYEEVSEAIKIAND
ref|YP_001274650.1|    LVTGGRRVRVPGFERGPFVEPTIFTNVLNGTRLAQEEIFGPVLSVIPYRTVTEAIELANA
ref|YP_001546552.1|    LRCGGVGIDDPNLANGHFVRPTIFTNVHNQMRIAQEEIFGPVLSVIRYHTVGEAITLAND
ref|YP_146052.1|       IVCGGHEVEVPGCEGGHFVAPTIFSNVTNDMKIAQEEIFGPVLSIIRYHDVEEAVTMAND
RAAC02275              LVCGGQRATGGGLDAGYFVQPTIFADVDNRMKIAQEEIFGPVLAVMKARDVDEAVRLAND
                       :  **        * :*  ****:.*    ::*:********:::   : **: :**
```

FIG. 73B

```
ref|YP_001636911.1|    SIYGLAASVWSRDLQHALSVVRRIRAGTVWINEHHVLNPRAPFGGYRQSGFGREMGRYGL
ref|ZP_01514632.1|     SIYGLAASVWSRDLQQALAVAKRIRAGTVWINEHHVLNPQAPFGGYRQSGFGREMGRYGL
ref|YP_001274650.1|    SRYGLGAAVWSRDLQGAIEVAKRIRTGTVWINDHHIILPRAPFGGYKQSGIGREHGIYGL
ref|YP_001546552.1|    TNYGLAASVWSRDLQDAQEVARAIRAGTVWINDHHLINAKAPFGGYKDSGIGRELGPNAL
ref|YP_146052.1|       TIYGLAAGVWTRDVNKAYAIAGRLQAGVVWINDWHMLRNDAPFGGYKQSGIGREMGKYSL
RAAC02275              TVYGLAGGVWTRDLNQAYRIAREIRAGTIWVNDWHMFRSDAPFGGYKMSGFGREIGPYAL
                       : *...:**::  *   :.  :::*.:*:*:  *::    ****: :*** *   .* ref|YP_001636911.1|    DEYTEVKHIHVDLMQRRQGRLWWDTLLPE--
ref|ZP_01514632.1|     DEYTEVKHIHVDLMQRRQGRLWWDTLLPE--
ref|YP_001274650.1|    MAYTELKHIHVDLMQKRTGRVWWDVLIP---
ref|YP_001546552.1|    DAYSEIKHIHTDLTQERTRRIWVDIVTP---
ref|YP_146052.1|       DAYTQLKHVHTSMVPELGKRKWYQVL-----
RAAC02275              DEYTQLKHVHASFVHELENRHWYSIVLPDRA
                       *:::**:*..:  .   *  *  . :
```

FIG. 74

```
pdb|1W85|A            ---------------------------------QFPT--FQILNEEGEVVNEEAMPELSDE
sp|P21873|ODPA_BACST  ---------------------------------QFPT--FQILNEEGEVVNEEAMPELSDE
ref|YP_146911.1|      ---------------------------------QFPT--FQILNEEGEIVNEEAMPELSDE
ref|YP_001421036.1|   ---------------------------------------QILNAEGEVVNKDAMPDLSDD
ref|NP_243521.1|      --------------------------LEKVEGQFET--FQILNEEGEVVNEAAMPDLSDE
RAAC02426             -------------------------MTMLSQVVARFEIPYVQIVDENGNVVNPDLVPELSDD
                                                                **::  :*::**    :*:***:

pdb|1W85|A            QLKELMRRMVYTRILDQRSISLNRQGRLGFYAPTAGQEASQIASHFALEKEDFILPGYRD
sp|P21873|ODPA_BACST  QLKELMRRMVYTRILDQRSISLNRQGRLGFYAPTAGQEASQIASHFALEKEDFILPGYRD
ref|YP_146911.1|      QLKELMRRMVYTRILDQRSISLNRQGRLGFYAPTAGQEASQIASHFALEKEDFILPGYRD
ref|YP_001421036.1|   QLKELMRRMVYIRILDQRSISLSRQGRLGFYAPTAGQEASQIASHFALEQDDFILPGYRD
ref|NP_243521.1|      QLQELMKRMVYTRIWDQRAISLNRQGRLGFYAPVAGQEASMLGSQFALDKEDWILPGYRD
RAAC02426             DLRELMKRMVFTRIWDQRAIRLSRQGRLGFYAPVSGQEASMIGSEFATKKEDFLLPGYRD
                      :*:*:*:  *:* *.********.:**  :.*.**  .::*::****** pdb|1W85|A            VPQIIWHGLPLYQAFLFSRGHFHGNQIPEGVNVLPPQIIIGAQYIQAAGVALGLKMRGKK
sp|P21873|ODPA_BACST  VPQIIWHGLPLYQAFLFSRGHFHGNQIPEGVNVLPPQIIIGAQYIQAAGVALGLKMRGKK
ref|YP_146911.1|      VPQIIWHGLPLYQAFLFSRGHFHGNQIPEGVNVLPPQIIIGAQYIQAAGVALGLKMRGKK
ref|YP_001421036.1|   VPQLIWHGLPLHQAFLFSRGHFKGNQMPEGVNALSPQIIIGAQIIQTAGVALGLKKRGKK
ref|NP_243521.1|      IPQIVFHGLPLYQAFLYSRGHFEGGQIPDGVNVLMPQIIIGAQIVQAAGVAMGLRKGKQ
RAAC02426             IPQLYFHGYPLHQLFLYSRGHQLGGKVPEGVNCMVPQIIIGAQIVQAAGVGLAFKLRGEK
                      :**: :** **:* **:****    *.::*:***  :  ********  :*:***.::.:*  :*::

pdb|1W85|A            AVAITYTGDGGTSQGDFYEGINFAGAFKAPAIFVVQNNRFAISTPVEKQTVAKTLAQKAV
sp|P21873|ODPA_BACST  AVAITYTGDGGTSQGDFYEGINFAGAFKAPAIFVVQNNRFAISTPVEKQTVAKTLAQKAV
ref|YP_146911.1|      AVAITYTGDGGTSQGDFYEGINFAGAFKAPAIFVVQNNRFAISTPVEKQTIAKTLAQKAV
ref|YP_001421036.1|   AVAITYTGDGGASQGDFYEGMNFAGAFKAPAIFVVQNNRYAISTPVEKQSSAQTIAQKAV
ref|NP_243521.1|      NVAITYTGDGGASQGDFYEGMNFAGAYNSPAIFVVQNNRFAISVPVEKQSAAKTIAQKAV
RAAC02426             RVAVTYTGDGGTSQGDFYEGMNFAGAMNLPVVFFVQNNQYAISVPRELQTRAQTLAQKAI
                      **:*******:********.*****   : *.:*.****::***.*  *  *:  *:*:****:

pdb|1W85|A            AAGIPGIQVDGMDPLAVYAAVKAARERAINGEGPTLIETLCFRYGPHTMSGDDPTRYRSK
sp|P21873|ODPA_BACST  AAGIPGIQVDGMDPLAVYAAVKAARERAINGEGPTLIETLCFRYGPHTMSGDDPTRYRSK
ref|YP_146911.1|      AAGIPGIQVDGMDPLAVYAAVKAARERAINGEGPALIETLCFRYGPHTMSGDDPTRYRSK
ref|YP_001421036.1|   AVGITGVQVDGMDALAVYAATAEARQRAINGEGPTLIETLTFRYGPHTMSGDDPTKYRTK
ref|NP_243521.1|      AAGIEGIQVDGMDVLAVYAATKQARERALAGDGPTLIETLCYRYGPHTMAGDDPTRYRSS
RAAC02426             AAGIPGVQVDGMDVLAVYHVMHEALERARNGEGPTMIEAVTFRYGPHTMSGDDPTRYRTK
                      *.** *:****** ****    . * :**  *:**:::**::  :*******:****:**:.

pdb|1W85|A            ELENEWAKKDPLVRFRKFLEAKGLWSEEEENNVIEQAKEEIKEAIKKADETPKQKVTDLI
sp|P21873|ODPA_BACST  ELENEWAKKDPLVRFRKFLEAKGLWSEEEENNVIEQAKEEIKEAIKKADETPKQKVTDLI
ref|YP_146911.1|      ELENEWAKKDPLVRFRKFLEAKGLWSEEEENRVIEQAKEDIKEAIKKADETPKQKVTDLI
ref|YP_001421036.1|   EIENEWEQKDPLVRFRKFLENKGLWSEEEENKVIEQAKEEIKQAIKKADGESKPKVTELI
ref|NP_243521.1|      DLDDEWEKKDPLVRFRKFLEGKGLWSEEQENEVVEKAKEDIKAAIKKADAAPKQKVTDLI
RAAC02426             DVQEEWEKKDPLIRFRKYLEEKGLWSQEEEAYIEEAKETVNNALKEADAAEKMTIPGLI
                      ::::**  :****:****:** *****:*:*:  :*:*** ::  *:*:**    * .::. **

pdb|1W85|A            SIMFEELPFNLKEQYEIYKEKES-
sp|P21873|ODPA_BACST  SIMFEELPFNLKEQYEIYKEKES-
ref|YP_146911.1|      SIMFEELPANLKEQYEIYKEKES-
ref|YP_001421036.1|   ENMFEEPTFNLKEQLEIYKAKES-
ref|NP_243521.1|      GFMFEEAPQHLREQLEEYTAKES-
RAAC02426             DSMFEELTPTLKRQRAEFAGEEAN
                       ****  .  *:.*   :  :*:
```

FIG. 75

```
sp|P21874|ODPB_BACST    ------------------------------------------------MAQMTMVQAI
pdb|1W85|B              -------------------------------------------------AQMTMVQAI
ref|YP_001125046.1|     ------------------------------------------------MAQMTMVQAI
ref|YP_146912.1|        ------------------------------------------------MAQLTMVQAI
ref|ZP_01696304.1|      ------------------------------------------------MAQLTMIQAI
RAAC02427               -----------------------------------------MPARRRTDMAQMTMIQAI
                                                                         ::*** sp|P21874|ODPB_BACST    TDALRIELKNDPNVLIFGEDVGVNGGVFRATEGLQAEFGEDRVFDTPLAESGIGGLAIGL
pdb|1W85|B              TDALRIELKNDPNVLIFGEDVGVNGGVFRATEGLQAEFGEDRVFDTPLAESGIGGLAIGL
ref|YP_001125046.1|     TDALRIELKNDPNVLIFGEDVGVNGGVFRATEGLQAEFGEERVFDTPLAESGIGGLAVGL
ref|YP_146912.1|        TDALRIEMRNDPNVLVFGEDVGVNGGVFRVTEGLQAEFGEERVFDTPLAESGIGGLAIGL
ref|ZP_01696304.1|      TDALRTELKNDENVLVFGEDVGVNGGVFRATEGLQKEFGKDRVIDTPLAESGINGLAIGL
RAAC02427               THALDLELARDERVLVFGEDVGKNGGVFRATEGLQQKYGPNRVFDTPLAESGIIGLANGL
                        * ** *: .* .:* **.*** ::* ::***** * ** sp|P21874|ODPB_BACST    ALQGFRPVPEIQFFGFVYEVMDSICGQMARIRYRTGGRYHMPITIRSPFGGGVHTPELHS
pdb|1W85|B              ALQGFRPVPEIQFFGFVYEVMDSICGQMARIRYRTGGRYHMPITIRSPFGGGVHTPELHS
ref|YP_001125046.1|     ALQGFRPVPEIQFFGFVYEVMDSISGQMARIRYRTGGRYHMPITVRSPFGGGVHTPELHS
ref|YP_146912.1|        ALQGFRPVPEIQFFGFVYEAMDAICGQMARIRYRTGGRYHVPITIRSPFGGGVHTPELHS
ref|ZP_01696304.1|      ALQGFRPVPEIQFFGFVFETMDSIHGQMARYRFRTGGDLKMPITIRAPFGGGVHTPEMHA
RAAC02427               AIQGFRPVPEIQFFGFVFEAFDQIAGQLARTRYRTGGRYTAPVTIRSPFGGGVHTPEMHA
                        *:***************:*.:* * **:** *:****    *:*:*:**********:*:

sp|P21874|ODPB_BACST    DSLEGLVAQQPGLKVVIPSTPYDAKGLLISAIRDNDPVIFLEHLKLYRSFRQEVPEGEYT
pdb|1W85|B              DSLEGLVAQQPGLKVVIPSTPYDAKGLLISAIRDNDPVIFLEHLKLYRSFRQEVPEGEYT
ref|YP_001125046.1|     DSLEGLVAQQPGLKVVIPSTPYDAKGLLISAIRDNDPVIFLEHLKLYRSFRQEVPEGEYT
ref|YP_146912.1|        DSLEGLVAQQPGLKVVIPSTPYDAKGLLISAIRDNDPVIFLEHLKLYRSFRQEVPEGEYT
ref|ZP_01696304.1|      DSLEGLMAQTPGIKVVIPSTPYDAKGLLISAIRDNDPVVFLEHMKLYRSFREEVPEEEYT
RAAC02427               DSLEGLFVQTPGIKVVIPSTPYDAKGLLLSAIRDPDPVIFLEHMKLYRSFRQEVPEDDYT
                        ******..* **:*************:***** *** ***:*:*******:****  :**

sp|P21874|ODPB_BACST    IPIGKADIKREGKDITIIAYGAMVHESLKAAAELEKE-GISAEVVDLRTVQPLDIETIIG
pdb|1W85|B              IPIGKADIKREGKDITIIAYGAMVHESLKAAAELEKE-GISAEVVDLRTVQPLDIETIIG
ref|YP_001125046.1|     IPIGKADIKREGKDITIIAYGAMVHESLKAAAELEKE-GISAEVVDLRTVQPLDIETIIG
ref|YP_146912.1|        IPIGKADIKREGKDITIIAYGAMVHESLKAAAELEKE-GISAEVVDLRTVQPLDIETIIG
ref|ZP_01696304.1|      IPLGKADVKREGKDISIIAYGAMVHESLKAADELEKE-GYSAEVVDLRTVSPLDVETIVA
RAAC02427               IPLGVANVVREGKHATVIAYGAMVHVALKAAEQWSKEKGLEAEVIDLRTVNPIDIDTIVA
                        **:* *:: ****. :::*******  :**** ::    . ** * .***:****.:*:*:.

sp|P21874|ODPB_BACST    SVEKTGRAIVVQEAQRQAGIAANVVAEINERAILSLEAPVLRVAAPDTVYPFAQAESVWL
pdb|1W85|B              SVEKTGRAIVVQEAQRQAGIAANVVAEINERAILSLEAPVLRVAAPDTVYPFAQAESVWL
ref|YP_001125046.1|     SVEKTGRAIVVQEAQRQAGIAANVVAEINERAILSLEAPVLRVAAPDTVYPFAQAESVWL
ref|YP_146912.1|        SVEKTGRAIVVQEAQRQAGIAANVVAEINERAILSLEAPVLRVAAPDTVYPFAQAESVWL
ref|ZP_01696304.1|      SVEKTNRAIVVQEAQRQAGVAANVVAEINERAILSLEAPVLRVTAPDTVYPFSQAEGVWI
RAAC02427               SVKKTNRAIVVQEAQRSAGAAAEIVAQINENAIYYLEAPVLRATPPDTVYPFGMIEDEWL
                        **:**.**********.**.**::***:***.**  *******.:.*******.  *. *:

sp|P21874|ODPB_BACST    PNFKDVIETAKKVMN-
pdb|1W85|B              PNFKDVIETAKKVMN-
ref|YP_001125046.1|     PNFKDVIETAKKVMN-
ref|YP_146912.1|        PNFKDVIETAKKVIN-
ref|ZP_01696304.1|      PTYKDILEKAKETLT-
RAAC02427               PTPEYVLKTLDKVMSL
                        *. : :::. .:.:.
```

FIG. 76A

```
sp|P11959|DLDH1_BACST      MVVGDFAIETETLVVGAGPGGYVAAIRAAQLGQKVTIVEKGNLGGVCLNV
pdb|1EBD|A                 --------ETETLVVGAGPGGYVAAIRAAQLGQKVTIVEKGNLGGVCLNV
ref|YP_001125048.1|        MVVGDFAIETETLVVGAGPGGYVAAIRAAQLGQKVTIVEKANLGGVCLNV
ref|YP_146914.1|           MVVGDFAIETETLVVGAGPGGYVAAIRAAQLGQKVTIVEKGNLGGVCLNV
ref|YP_001486601.1|        MVVGDFPIETDTLVIGAGPGGYVAAIRAAQLGQKVTIVEKGTLGGVCLNV
RAAC02429                  MVVGDIVEEVEVLVIGAGPGGYVAAIRAAQLGKSVTIVDKAELGGVCLNR
                           *.:.:*************:.**:*. ****** sp|P11959|DLDH1_BACST      GCIPSKALISASHRYEQAKHSEEMGIKAENVTIDFAKVQEWKASVVKKLT
pdb|1EBD|A                 GCIPSKALISASHRYEQAKHSEEMGIKAENVTIDFAKVQEWKASVVKKLT
ref|YP_001125048.1|        GCIPSKALISAGHRYEQAKHSEEMGIKAENVTVDFSKVQEWKASVVKKLT
ref|YP_146914.1|           GCIPSKALISASHRYEQAKHSEEMGIKAENVTVDFSKVQEWKASIVKKLT
ref|YP_001486601.1|        GCIPSKALINAGHRFENAKHSEDMGIKAENVTVDFTKVQEWKASVVNKLT
RAAC02429                  GCIPSKALISAAHHYEAAKESPFPGIETT-ATFDFKKVQEWKQSVVKKMT
                           *********.*.*::* **.*  **::  .*. **** *:*:*:* sp|P11959|DLDH1_BACST      GGVEGLLKGNKVEIVKGEAYFVDANTVRVVNGDSAQTYTFKNAIIATGSR
pdb|1EBD|A                 GGVEGLLKGNKVEIVKGEAYFVDANTVRVVNGDSAQTYTFKNAIIATGSR
ref|YP_001125048.1|        GGVEGLLKGNKVEIVKGEAYFVDANTVRVVNGDSAQTYTFKNAIIATGSR
ref|YP_146914.1|           GGVEGLLKGNKVDIVKGEAYFVDANTVRVVNGDSAQTYTFKNAILATGSR
ref|YP_001486601.1|        GGVQGLLKGNKVDIVKGEAYFVDSNSVRVMDENSAQTYTFKNAILATGSR
RAAC02429                  SGVQQLLKGNKVNVIHGEAFFTKPNEVRVMQENGSQRLQFQHCILATGSR
                           .: ****::::*:*...* ***:: ...*   *::.*:***** sp|P11959|DLDH1_BACST      PIELPNFKFSNRILDSTGALNLGEVPKSLVVIGGGYIGIELGTAYANFGT
pdb|1EBD|A                 PIELPNFKFSNRILDSTGALNLGEVPKSLVVIGGGYIGIELGTAYANFGT
ref|YP_001125048.1|        PIELPNFKFSNRILDSTGALNLGEIPKSLVVIGGGYIGIELGTAYANFGA
ref|YP_146914.1|           PIELPNFKFSGRILDSTGALNLGEIPKSLVVIGGGYIGIELGTAYANFGA
ref|YP_001486601.1|        PIELPTFKYTDRVINSTGALALKEVPKKLVVIGGGYIGTELGTAYANFGT
RAAC02429                  PIELKNLPLGKRVIDSTGALSLDHVPKRLVVVGGGYIGIELGQTFAKFGS
                           **** .:   *:::***** * .:** ***:****** ***  :*:*:**:

sp|P11959|DLDH1_BACST      KVTILEGAGEILSGFEKQMAAIIKKRLKKKG-VEVVTNALAKGAEEREDG
pdb|1EBD|A                 KVTILEGAGEILSGFEKQMAAIIKKRLKKKG-VEVVTNALAKGAEEREDG
ref|YP_001125048.1|        KVTILEGAGEILSGFEKQMAAIIKKRLKKKG-VDIVTNALAKGAEEREDG
ref|YP_146914.1|           KVTILEGAGEILSGFEKQMVSIIKRRLKNKG-VEVVTNALAKGAEERADG
ref|YP_001486601.1|        EVVILEGGDEILPGFEKQMSSLVKRNLKKKGNVEIHTNALAKGVEEKSDG
RAAC02429                  QVTIIEGLDSILALFDKQMVRLVEKNLKKYN-VQIETNALAQGVEETEDG
                           :*.*:**  .**. *:***  :::: **: . *:: *****:*.**  **

sp|P11959|DLDH1_BACST      VTVTY-EANGETKTIDADYVLVTGRRPNTDELGLEQIGIKMTNRGLIEV
pdb|1EBD|A                 VTVTY-EANGETKTIDADYVLVTGRRPNTDELGLEQIGIKMTNRGLIEV
ref|YP_001125048.1|        VTVTY-EANGETKTVDADYVLVTGRRPNTDELGLEQVGIKMTDRGLIEV
ref|YP_146914.1|           VTVTY-EANGETKTIDADYVLVTGRRPNTDELGLEQIGIKMTNRGLIEV
ref|YP_001486601.1|        VTVTFEVK-GEEKTVDADYVLVTGRRPNTDELGLEQVGVELTDRGVVKT
RAAC02429                  VKLTYKDKDGNEKTIEADYVLVTGRRPNTDEIGLQDAGIELTDKGLVKV
                           *.:*:   *: **:****************:**:: *:::*:*::::.

sp|P11959|DLDH1_BACST      DQQCRTSVPNIFAIGDIVPGPALAHKASYEGKVAAEAIAGHPSAVDYVAI
pdb|1EBD|A                 DQQCRTSVPNIFAIGDIVPGPALAHKASYEGKVAAEAIAGHPSAVDYVAI
ref|YP_001125048.1|        DQQCRTSVPNIFAIGDIVPGPALAHKASYEGKVAAEAIAGHPSVVDYVAI
ref|YP_146914.1|           DQQCRTSVPNIFAIGDIVPGPALAHKASYEGKVAAEAIAGHPSVVDYIAI
ref|YP_001486601.1|        DKQCRTSVSNIYAIGDIVDGPPLAHKASYEGKIAAEAIAGEPAEIDYLGI
RAAC02429                  DQQCRTTNPNVFAIGDIVPGPALAHKASYEGKVAAEVIAGKPSIVDYRCI
                           *:****: .*:******* **.*********:***.***.*:  :**  *
```

FIG. 76B

```
sp|P11959|DLDH1_BACST      PAVVFSDPECASVGYFEQQAKDEGIDVIAAKFPFAANGRALALNDTDGFL
pdb|1EBD|A                 PAVVFSDPECASVGYFEQQAKDEGIDVIAAKFPFAANGRALALNDTDGFL
ref|YP_001125048.1|        PAVVFSDPECASVGYFEQQAKDEGIDVITAKFPFAANGRALALNDTDGFL
ref|YP_146914.1|           PAVVFSDPECASVGYFEQQAKEEGIDVITAKFPFAANGRALSLNDTDGFL
ref|YP_001486601.1|        PAVVFSEPELATVGYTEAEAKEEGIDIVAAKFPFAANGRALSLDATDGFM
RAAC02429                  PSVVFSDPEMASVGLTEEEAKKEYGQVAVGRFPYAANGRATALNATDGFI
                           *:****:** *:**   * :**.*   ::  ..:**:****** :*: ****:

sp|P11959|DLDH1_BACST      KLVVRKEDGVIIGAQIIGPNASDMIAELGLAIEAGMTAEDIALTIHAHPT
pdb|1EBD|A                 KLVVRKEDGVIIGAQIIGPNASDMIAELGLAIEAGMTAEDIALTIHAHPT
ref|YP_001125048.1|        KLVVRKEDGVVIGAQIIGPNASDMIAELGLAIEAGMTAEDIALTIHAHPT
ref|YP_146914.1|           KLVVRKEDGVVIGAQIIGPNASDMIAELGLAIEAGMTAEDIALTIHAHPT
ref|YP_001486601.1|        KMITRKEDGLVIGAQIAGVGASDMISELSLAIEAGVTAEDIAMTIHAHPT
RAAC02429                  KLVANKENGVLVGAQVVGVEASNIIAELGLAIEMSATLEDIALTIHAHPT
                           *::..**:*:::***: *  **::*:.**  *  **:***** sp|P11959|DLDH1_BACST      LGEIAMEAAEVALGTPIHII--
pdb|1EBD|A                 LGEIAMEAAEVAL---------
ref|YP_001125048.1|        LGEIAMEGAEVALGTPIHII--
ref|YP_146914.1|           LGEIAMEAAEVALGTPIHII--
ref|YP_001486601.1|        LGEITMETAEVAIGSPIHIVK-
RAAC02429                  LGEMVMEAAEVGLGEPIHIIKG
                           ***:.** ***.: 
```

FIG. 77A

```
ref|YP_001127390.1|    MSIRAEEISALIKQQIENYESQIQVSDVGTVIQIGDGIARVHGLDNVMSGELVEFANGVM
ref|YP_149213.1|       MSIRAEEISALIKQQIENYESQIQVSDVGTVIQVGDGIARAHGLDNVMSGELVEFANGVM
pdb|2QE7|A             MSIRPEEISALIKKQIENYEADLEVVEVGTVIQVGDGIARVHGLEKVMAGELLEFENGVM
ref|YP_361340.1|       MNLRPEEIGSIIKQQIENYQVQVEVSSVGTVIQVGDGIARVYGLEDCMASELLEFPGGVL
RAAC00452              MSIRPDEISALIKQQIEQFEVKAEVRDTGTVLSVGDGIARLYGLDNVMAGELVEFESGVY
ref|YP_001356688.1|    --LQADEISSIIKERIEDFELKIDVEETGKVISFGDGVAKVFGLNNVMAGEMLEFDNGDK
                         ::.:.::::**::: . :* ..*.*:..***:*: .**:. *:.:**  .* ref|YP_001127390.1|    GMALNLEENNVGIVILGPYTGIKEGDEVRRTGRIMEVPVGEALIGRVVNPLGQPVDGLGP
ref|YP_149213.1|       GMALNLEENNVGIVILGPYTGIKEGDEVRRTGRIMEVPVGEALIGRVVNPLGQPVDGLGP
pdb|2QE7|A             GMAQNLEEDNVGVVILGPYTEIREGTQVKRTGRIMEVPVGEALLGRVVNPLGQPLDGRGP
ref|YP_361340.1|       GMALNLEEDNVGCVILGPYTHIKEGDTVKRTGRVVSVPVGEALIGRVVNPLGQPLDGKGP
RAAC00452              GMALNLEEDNVGVVVLGSVQGIREGEQVRRTGRLVTVPVGPQLLGRVVNALGQPIDNKGP
ref|YP_001356688.1|    GMALNLEETNVGVVVLGRGEGIREGSSVKRLGQLLKAPVGEALVGRVINAIGEPIDKGP
                       ***  ****  ***  *:**        *:**   *:* *:::  .***   *:****:*.:*:*:*. **

ref|YP_001127390.1|    VETTETRPIESPAPGVMDRKSVHEPLQTGIKAIDALVPIGRGQRELIIGDRQTGKTAVAI
ref|YP_149213.1|       VETTETRPIESPAPGVMDRRSVHEPLQTGIKAIDALVPIGRGQRELIIGDRQTGKTSVAI
pdb|2QE7|A             IETAEYRPIESPAPGVMDRKSVHEPLQTGIKAIDSMIPIGRGQRELIIGDRQTGKTTIAI
ref|YP_361340.1|       IVTDKFRPVERIAPGVITRKSVHEPLQTGIKAIDSMIPIGRGQRELIIGDRQTGKTAIAI
RAAC00452              IEATEYRPVESPAPGVIVRRSVHEPLETGIKAIDSMVPIGRGQRELIIGDRQTGKTAIAL
ref|YP_001356688.1|    IEATEYRYVEEKAPGIMARKSVHEPLQTGIKAIDALVPIGRGQRELIIGDRQTGKTTVAI
                       : : : * :*   ***::  *:****:*:******::::****************::*:

ref|YP_001127390.1|    DTILNQKGQDMICIYVAIGQKESTVRTVVETLRKHGALDYTIVVTASASQPAPLLFLAPY
ref|YP_149213.1|       DTIINQKDQNMICIYVAIGQKESTVRTVVETLRKHGALDYTIVVTASASQPAPLLFLAPY
pdb|2QE7|A             DTIINQKGQDVICIYVAIGQKQSTVAGVVETLRQHGALDYTIVVTASASEPAPLLYLAPY
ref|YP_361340.1|       DTIINQKNTDVICIYVAIGQKASTVAKVVQTLKDHGAMDYTIVVSATASDPAPLLYLAPY
RAAC00452              DTIINQKGKDVKCIYVAIGQKQSTVAQVVETLRRYGAMEYTTVVVASASEPAPLLFLAPY
ref|YP_001356688.1|    DTIINQKGQDVVCIYVAVGQKQSTVAQVVKKLEEHGAMDYTIVVNAGASEPAALQFLAPY
                       *:*. :: *** :*  *  :.*.  :.*:    :**.*  :**** ref|YP_001127390.1|    AGVSMGEYFMYKGKHVLVVYDDLSKQAAAYRELSLLLRRPPGREAYPGDVFYLHSRLLER
ref|YP_149213.1|       AGVAMGEYFMYKGQHVLVVYDDLSKQAAAYRELSLLLRRPPGREAYPGDIFYLHSRLLER
pdb|2QE7|A             AGCAMGEYFMYKGKHALVVYDDLSKQAAAYRELSLLLRRPPGREAYPGDVFYLHSRLLER
ref|YP_361340.1|       AGCAMGEEFMEQGKHVLVVYDDLSKQAAAYRELSLLLRRPPGREAYPGDVFYLHSRLLER
RAAC00452              AGCAMAEYYLYNGQHALVVYDDLSKQAAAYREMSLLLRRPPGREAYPGDVFYLHSRLLER
ref|YP_001356688.1|    TGVTIGEYFRDNGKHALIVYDDLSKHAVAYREMSLILRRPPGREAYPGDVFYLHSRLLER
                       :* ::.*  :   :*:*.*:********:*.****:*:**********:******* ref|YP_001127390.1|    AAKLSDAKGAGSLTALPFVETQAGDISAYIPTNVISITDGQIFLQSDLFFSGVRPAINAG
ref|YP_149213.1|       AAKLSDAKGGGSLTALPFVETQAGDISAYIPTNVISITDGQIFLQSDLFFSGVRPAINAG
pdb|2QE7|A             AAKLSDEKGGGSLTALPFIETQAGDVSAYIPTNVISITDGQIFLESDLFYSGVRPAVNVG
ref|YP_361340.1|       AAKLSDEYGGGSLTALPIIETQAGDISAYIPTNVISITDGQIYLESDLFYAGVRPAVNVG
RAAC00452              AAKLNDEHGGGSLTALPFIETQAGDISAYIPTNVISITDGQIFLESDLFFAGVRPAINVG
ref|YP_001356688.1|    AAKLNDKLGAGSLTALPIIETQAGDVSAYIPTNVISITDGQIFLESDLFNAGIRPAINVG
                       ****.*  * ****:.**::************:*:****  :*:***:*.* ref|YP_001127390.1|    LSVSRVGGAAQIKAMKKVSGTLRLDLAAYRELEAFAQFGSDLDKATQAKLARGARTVEVL
ref|YP_149213.1|       LSVSRVGGAAQIKAMKKVAGTLRLDLAAYRELEAFAQFGSDLDKATQAKLARGARTVEVL
pdb|2QE7|A             ISVSRVGGAAQIKAMKKVAGTLRLDLAQYRELQAFAQFGSDLDKATQAKLNRGERTVEIL
ref|YP_361340.1|       LSVSRVGGAAQIKAMKQVAGSLRLDLAQYRELAAFAQFGSDLDKATLARLTRGERLVELL
RAAC00452              SSVSRVGSAAQTKAMKKVAGTLKLDLAQYRELQAFTQFGSDLDKATQDTLRRGERMTELL
ref|YP_001356688.1|    ISVSRVGGAAQIKAMKQVAGTLRLDLAQYRELEAFAQFASDLDEASRKQLERGMRMVEIL
                       ******.*** ****:***.*:*:*:****  **.**.****** .*: *.*  * .*:*
```

FIG. 77B

```
ref|YP_001127390.1|      KQDLHQPIPVEKQVAIIYALTRGFLDDIPVEDVRRFEKEFFLWLDQNGQHLLEHIRTTKD
ref|YP_149213.1|         KQDLHQPIPVEKQVLIIYALTRGFLDDIPVEDVRRFEKEFYLWLDQNGQHLLEHIRTTKD
pdb|2QE7|A               KQDEHKPMPVEEQVISIYAVTNGFMDDIPVEDVRRFEEELLSFMRANKDSLLDHIRQTGE
ref|YP_361340.1|         KQDQYKPMPVEEQVMAIFAAVNGYLDDLPVEKVRPFEAEFLKFMRANYPQIGEEIRTKGV
RAAC00452                KQPQYHPLTFDRQVASLWTGVNGYLDDIPVEAVQKFEREWLAFLDREYPQVFQQMQERKS
ref|YP_001356688.1|      KQPPYSPLPVEKQVVIIYAGANGFLDDIEVSAIGKFEYELYSFIEAKYPQIFELIRERKA
                         **  :  *:..:.**   :::  ..*::**: *. :  ** *    ::  :   : : ::

ref|YP_001127390.1|      L-PNE-----EDFNKAIEAFKKTFV-
ref|YP_149213.1|         L-PNEDD-----LNKAIEAFKKTFV-
pdb|2QE7|A               L-PDTKEL-----DAAIEEFKKGFTP
ref|YP_361340.1|         LTDELTSR----LKSAIEEFKKTF--
RAAC00452                LEDDTIEL----MKEAMAKFKPTFVP
ref|YP_001356688.1|      LDDEIKEL----LNKAIEEFKASF--
                         *  :         . *:  ** *
```

FIG. 78

```
ref|YP_644829.1|       ---MESRTIAVLEGDQTGQELLEEALRVLDPGVTGLELEFRRFDLSLENRRRTENRVVHE
RAAC02433              MTDMGKPTIIVMEGDQTGQELLEEALRVLSPDVTGYEIEIRKFDLSLENRRRTQNAVVHE
ref|YP_001542913.1|    ---MSKPTIVVLEGDQTGQELLEESLRVLDPAVTGVDIELKRYDLSLESRRATNNQIVLE
ref|YP_356005.1|       ------PTITVLEGDQTGQELLEEALRILDPAVTGVTVTFKHFDLSLDNRRATKNKVVYE
emb|CAO90974.1|        ------PTIVVMHGDQTGEELLLEALRVLQPSIIRQPLNFADVDLSLAQRRQSNNQVVHE
ref|YP_001656571.1|    ------PTIVVMHGDQTGEELLLEALRVLQPSIIRQPLNFADFDLSLAQRRQSNNQVVHE
                             ** *:.***:* *:**:*.*  :   : :   ** . ::* :* * ref|YP_644829.1|       AAAAMRECGYGIKAATITPERAGDVGSPNALLRKDINGTVIVRTGRRIPGVNPLPGVHAP
RAAC02433              AAEAMRDTGLGLKAATITPEEKGDVGSPNAILRKEINGTVIVRTGRRIPGIAPPVGVYSP
ref|YP_001542913.1|    AAQAMKEAGFGLKAATITPEKAGDVGSPNAILREQINGTVIVRTGRRIPGVRPVGGAYAP
ref|YP_356005.1|       AAESMKSTGLGLKAATITPAIKGDVGSPNAILRDQVDGTVIVRTGRRIPGIRPSGGAYAP
emb|CAO90974.1|        AAEATLKTGLALKAATITPEIKGDVGSPNAILREAMNSQVILRIGRRIPGIRPIGGVYSP
ref|YP_001656571.1|    AAEATLKTGLALKAATITPEIKGDVGSPNAILREAMNSQVILRIGRRIPGIRPIGGVYSP
                       **  :  . * .:****  ****:. ::. **:* ******: *  *.::* ref|YP_644829.1|       ISVVRMAVDDAYGAEEWREG-EGPDEVAYRTEKISRRVCRGVAEFAFIHARRMRAKVFGG
RAAC02433              ISVIRMAVDDAYGAKEWREQLENGDEVAYRTEKISRSVCRGVAKYAFQHARRMHAKVFGG
ref|YP_001542913.1|    ISVVRMAVDDAYGAKEWREG-EGDNEVAYRTEKITRGTCRAVSEYAFMHARRMKAKVFGG
ref|YP_356005.1|       ISVVRMAVGGSYGAQESR-QGTGLDEVASRTESITRRNCHAVAEFAFRHAQKLGVKVFGG
emb|CAO90974.1|        IAIVRMAVDDAYGAKEWRETTATGDEIAYRTSRISRATSRAVAEFTFQHAKKTGARVFGG
ref|YP_001656571.1|    IAIVRMAVDDAYGAKEWRETTATGDEIAYRTSRISRATSRAVAEFTFQQAKKTGARVFGG
                       *:::**..:*:*  *     :*:* **. *:*  .:.*::::* :*::  .:**** ref|YP_644829.1|       PKWTVSPVYEGMLKEEMDRAAEKNPDVRYEPQLIDATYALLLSTYGEPLVIPTLNRDGDC
RAAC02433              PKYTVSPVYEGMLKEEMDAAAAKEYPDVRYEPQLIDATYALLLARAGEALVIPALNRDGDC
ref|YP_001542913.1|    PKYTVSPIYEGMLKEEMDAAAKRYADVRYEPQLIDATYALLLTNSGDPMVIPALNRDGDC
ref|YP_356005.1|       PKFTVSPVYEGMLKEEMDAAAERFPDVVYEPQLIDATYALLLTNGGDGMVIPSLNRDGDC
emb|CAO90974.1|        PKFTVSATYEGMFKEELDAAAQRHPEVRYQPLLIDATFALLLQTDGEALVIPALNRDGDL
ref|YP_001656571.1|    PKFTVSATYEGMFKEELDAAAQRHPEVRYQPLLIDATFALLLQTDGEALVIPALNRDGDL
                       :*. **:*:* **:. .:* *:* ***:**   *: :*:**** ref|YP_644829.1|       LSDMVLQMFGSIAGAESLLIALDEE-ERPQTVMAEAPHGTAPSLEGKNIANPMAMILAGA
RAAC02433              LSDLVLQMFGTIAGSESLLLSLDES-FQPKVVMAEAPHGTAPNLFRKNMANPMAMILAGA
ref|YP_001542913.1|    LSDLVLQMFGTIAGAESLLLAFDKD-FKVNVVMAEAPHGTAPSLEGKNVANPMAMILASA
ref|YP_356005.1|       LSDFVLQMFGSIAGAESLLLSFDES-WTPAVVMAEAPHGTAPSLQGKNIANPMAMILAGG
emb|CAO90974.1|        LSDFVLQLYGSIAGAESLVLGFDEETLAVKTIMAEAPHGTAPALEGKNIANPMAMILASA
ref|YP_001656571.1|    LSDFVLQLYGSIAGAESLVLGFDEETLAVKTIMAEAPHGTAPALEGKNIANPMAMILAAA
                       ***:***::*:***:***::..:*:.  .:********** *  **:*********..

ref|YP_644829.1|       ALLGFFEDEQAGRVSRAIYESTFETVLDGVKTADLGGSATTTEFTDEVIRHVRNKLEVWS
RAAC02433              ALLNYIQDKDAHTVSRAIYEATLESIVDGIRTADLGGHATTTEFTDEVIRRVRTKLEVWS
ref|YP_001542913.1|    ALLDYIDTPQANMAARAISEATLEAVYDGVRTADLGGHTTTSDFTDEVIRRVKTKMEVWP
ref|YP_356005.1|       ALLRYINHPDARRAARAISESVFEAVQQGFSTPDLGGSCTTTEFTDEVIRRVASKLEVWQ
emb|CAO90974.1|        ALLGYIETSEARKASRAIYESVFETIHEGKKTPDLGGQMTMSEFTDEVIRRVVSKLEVWS
ref|YP_001656571.1|    ALLGYIETNEARKASRAIYESVFETIHEGKKTPDLGGQMTMSEFTDEVIRRVVSKLEVWS
                       *** :::  :*  .:*** *:..*:: :*  *.****  *  ::********:* .*:*** ref|YP_644829.1|       ------
RAAC02433              TFGDAV
ref|YP_001542913.1|    SLGN--
ref|YP_356005.1|       TLG---
emb|CAO90974.1|        ALG---
ref|YP_001656571.1|    ALG---
```

FIG. 79A

```
ref|YP_644476.1|      ------------------DDFWASLTSRMPRRLDYETLYEGFSWDLPRPYNIGTDVCDR
RAAC02438             MPCHREMKGAIEHEEVVLMDDLWT-VDGDDLRKLPYGAMYAKFRWPTPDRLNIAEWACRR
ref|ZP_01015586.1|    ----------------------------------WAALRRAFRWTVPDGFNMADACCDS
ref|ZP_02191297.1|    ----------------------------------YEAVRERFRWRIPQRYNIGVDVCDR
ref|ZP_01549387.1|    ----------------------------------YDDLSGRFKWEIPDRFNIGVAICDD
ref|ZP_01850519.1|    ----------------------------------YEAFRSGFRWRIPERYNIAVDVCDR
                                                        :  .  * *  * *:.  * ref|YP_644476.1|      HAWE-PGRLALIHDRGDGTAEKW-TFRELKLASDRFANAL-RGLGVERGDRVAVLLSQTP
RAAC02438             HARVCPDAPAIWYDVDGGSAEMW-TFGHLWRTTSRLAWALLRGLGVPTGGRVAILLPQSP
ref|ZP_01015586.1|    WARDEPGRVAVTHV--GHETRDW-TFGELKDASDRLAGAFADA-GVGRGDRVGVLLGQSP
ref|ZP_02191297.1|    HADAGAG-TALIHIAADGAVVEH-SFTELKRQSNRLA-NVLTAAGLQRGDRVGILMPQRP
ref|ZP_01549387.1|    WAAREPNREALVYTDEDGSATSY-TYDDLRRLSNQLA-NLLTARGVQPGDRIGVLMPQRP
ref|ZP_01850519.1|    WAAADPQRPALLDVSADGRVETW-SFAALREASDRFANAL-RALGIARGDRVAVLLPQSP
                       *    .   *:     .    :: *   :..:*  . .*: *.*:..*: * * ref|YP_644476.1|      QLPVAHIAVYKLGAVTVPLFALFGEDALRFRLSDSGARVIVTDEEHFEVAASLREELEEL
RAAC02438             QLAAAHLASYAIGAIAVPLFTLFGTDALRYRLQDSGATVVVTDSEQANRIMDIRADLPDL
ref|ZP_01015586.1|    ETLIAHLATWKRGGISIPLFSLFGPDALAFRLADSGTKAVVTDAAGAEKLAAVRGELPDL
ref|ZP_02191297.1|    ETAIAHIAAHKAGMVSVPLFTLFGEDALAYRLGDCAAAALVTDRDSLPKIEAIRDHLPSL
ref|ZP_01549387.1|    ETAFAHIAALKLGAISIPLFTLFGEEALEYRLKDSGAKVVITDASGAAKLATIRDRLPEL
ref|ZP_01850519.1|    AVLIAHLAVYKLGAVALPLAVVFGPDALLHRLGDSGAKAVVTHAGGVAKLLPLRDALPEL
                        **:*    * ::: : : .  *..: .::*.         :*  * .* ref|YP_644476.1|      EHVVLTGGGRAGALGFDDLVRE--ASPF-FRPVETGPDDPAIIIYTSGTTGSPKGALHGH
RAAC02438             EHVIVTDARVPGTQFWDDVLAL--ASSAEYHPMDASPDDPAVLIYTSGTTGSAKGALHGH
ref|ZP_01015586.1|    AQVFAVGGGT-GRDFWAEVEA-----ASPVDPVPVGAEDPAVIIYTSGTTGPPKGALHAH
ref|ZP_02191297.1|    KLILVADTAKNGSGWRALDLALDAASDA-FTPVDTSADDPAVIIYTSGTTGQPKGALHAH
ref|ZP_01549387.1|    TTVLCADEDVPWAESLHHHMA--GHEGT-FHPFDTGPDDPAIIIYTSGTTGQPKGALHGH
ref|ZP_01850519.1|    ALVVSTDG--PGDGALGFAALLEAAAPA-LAPVETGPDDPALMIYTSGTTGPPKGALHGH
                       :.  ..              *.   ...:*::****  .***.* ref|YP_644476.1|      RILLGHLPGVSLPHDLAPRRGDLFWTPADWAWIGGLFDVLFPALHWGLPVLSCRMRRFDP
RAAC02438             RILLGHLPGVSLPHDFAPQPGDVFWTPADWAWIGGLYDVLLPALCWGVPVVAHRIRKFDP
ref|ZP_01015586.1|    RFLIGHLPSVELHHEGFPHPGDVGWTPADWAWIGGLMDMAMPCLYHGVRLVSCRMRKFDA
ref|ZP_02191297.1|    RVLLGHLPGVEFPQEFFPAPGDRFWTPADWAWIGGLLDVLLPSLHHGIPVVAHRFAKFDP
ref|ZP_01549387.1|    RVLLGHLPGVEMSHDLLGQPGDRIWTPADWAWIGGLLDVLMPALYLGVPVVACRFRKFTA
ref|ZP_01850519.1|    RVLLGHLPGFAMMHDFMPRPGDRMWTPADWAWAGGLLNALLPSLHHGVAVVARKAEKFEP
                      *.*:****..  :  ::       ** ******* ***  ; :*.*  *: ::: :  :* .

ref|YP_644476.1|      ERAFDLMERWGVRNVFLPPTALKMMRAVGSPRSR-WRLELETLACGGEPLGEESLAWARE
RAAC02438             ERAFALMERWRVRNAFMPPTSLKMMRHITDPRSR-WHLHLRTLATGGEPLGAELLSWARE
ref|ZP_01015586.1|    DEAYRLIADQRVRNLFLPPTALKLMRQAEVPED----VDIRTIGSGGEALGADLLAWAQD
ref|ZP_02191297.1|    EAAFDLIARHRVRNSFLPPTALKLMRQVPDPLARHALA-MRSIGSGGETLGTELLEWGRS
ref|ZP_01549387.1|    EAAFQLLQDQKIRNTFLPPTALKMMRQVEAPEKRWRFT-LRSVASGGETLGAELIDWGRR
ref|ZP_01850519.1|    EEALRLIADHAVANAFVPPTALRMLRTVARPRARFDLSRLRTLASAGEMLGPETFAWARD
                      :  *   *:     : * *:***:*::::*    *        :.::.  .** **  : :  *.:

ref|YP_644476.1|      ELGLPINEFYGQTECNLVLSNCSAIMPIKPGSMGRPVPGHRVAIIDAEGRELPPGEVGEV
RAAC02438             ALGLSIHEFYGQTECNLVVANCSACFQPKPGSMGRPVPGHDVAVIDENGHVVSPGVIGEI
ref|ZP_01015586.1|    ALGVTINEFYGQTECNLVLASCAGSMAVKPGSMGQAVPGHEVAVIDAEGQVVAPGTVGEI
ref|ZP_02191297.1|    VFGLTINEFYGQTECNLVVGNCASILPVRPGSMGKPVPGHEVAIVDANGIPLPASETGAI
ref|ZP_01549387.1|    TFGLTINEFYGQTECNMIVSSCARLMEARPGIMGRPVPGHHVSVVSDKGEELPAGTLGNI
ref|ZP_01850519.1|    ALGLTVNEAYGQTECNLVLASCAALGLARAGSTGKPVPGHRVAVIRPDGTAADPDEIGQI
                      :*:..::* *******::..*:     . .   *:.****  *:.****  *::: . .*  .. * :
```

FIG. 79B

```
ref|YP_644476.1|      AVLRPDPVMMLGYWNNERATEAKFVG---DWLRTGDLATRDGEGYFRFVGRDDDVITSSG
RAAC02438             AVRRPHPVMFIGYWNRPEETAAKFVG---DWLKTGDLGRMDEEGYLWFVGRADDVITSAG
ref|ZP_01015586.1|    AVKRPDPVMFLGYWNLPEKTAAKFTG---DWMRTGDLGVCDEDGYFTYVSRDDDVITSAG
ref|ZP_02191297.1|    AVKRGDPVMFLGYWNNPQATDAKFTGPDKQWMLTGDLGRQDEDGYLHYVGRDDDVITSAG
ref|ZP_01549387.1|    AVKRPDPVMFLNYWNNMEATEKKFAG---DWLLTGDTGIKDDTGWIRFVGRDDDVITSSG
ref|ZP_01850519.1|    AVARPDPVMFLGYWRDEAATARKFLG---DWMTTGDQGRVDADGYVHFVGRDDDVITSSG
                      ** * .*:..         * ** *    :*: *** .  *  *:. :*.* ******:* ref|YP_644476.1|      YRIGPAEIEETLVKHPRVLMAAAVGRPDPVRGEVVKAFVVLREG-EGDEALAEELKELVR
RAAC02438             YRIGPVEIEEAALQHSAVVMAAAVGTPDPVRGEVVKLFVKLREGVPANECLTAELQNWVK
ref|ZP_01015586.1|    YRIGPTEIETCLTGHPDVVMAAAVGVPDETRGEVVKAYVVLRDGA-ATEGLADRLIQRVR
ref|ZP_02191297.1|    YRIGPGEIEDCLTAHPSVALAAVIGVPDPLRTEAIKACVVLADGVAPSDSLKAEIQNHVK
ref|ZP_01549387.1|    YRIGPGEIEDCLIKHPAVAMAGVVGKPDSQRTEIVKAYIVLKKGFEPTDKLAGEIADFVK
ref|ZP_01850519.1|    YRIGPGEIEDCLLRHPAVALAAAVGKPDPVRTEIVKAFVVLRPGFAASAALATEIQDFVR
                      ***** ***       *. * :*..:* **  * *  :*   : * *         * .: : *:

ref|YP_644476.1|      RRLGAHEYPREVEFVPELPLTATGKIRRNVLRARE-------------
RAAC02438             ERVGAHSYPREIEFVDELPLTPSGKVRRRALREREYAQKGVPLPGKRG
ref|ZP_01015586.1|    EKVSPHVAPRIVEFVDDLPMTATGKIMRRSLRD---------------
ref|ZP_02191297.1|    RRLAAHEYPRIVEFVDSLPMTTTGKIMRRVLRERHAAE----------
ref|ZP_01549387.1|    TRLAAHEYPREVAFVDALPLTTTGKVIRRELRAR--------------
ref|ZP_01850519.1|    RHLSAHEYPREIAFRSSLPLTTTGKIIRRVLRD---------------
                      ::..*   ** : *    **:*:.**: *. **
```

FIG. 80A

```
ref|YP_147804.1|       --------------------------------------------SSVTETKTLKNFI
ref|YP_001125954.1|    --------------------------------------------SSVTETKTLKNFI
ref|YP_001125911.1|    --------------------------------------------------LKNYI
ref|YP_147740.1|       --------------------------------------------------LKNYI
ref|NP_243178.1|       -----------------------------------------ANLATGEKLKNFI
RAAC02441              MAAQRTTRSCPRTRRSSSCTGRPMTPRGMQRRWNRLQNEGEGKMHRTSSVSVAGHLRNWI
                                                                         *:*:* ref|YP_147804.1|       GGQWVASTSGKEEVVPNPATGEVLAKVPLSSREELDAAVAAAKEAFREWRKVPVPRRARI
ref|YP_001125954.1|    GGQWVASTSGKEEIVPNPATGEVLAKVPISSREELDAAVAAAKEAFREWRKVPVPRRARI
ref|YP_001125911.1|    GGQWVESRSAKTEAVPNPATGEVLAYVPISTREDLDRAVAAAKEAFKTWSKTPVPRRARI
ref|YP_147740.1|       GGQWVESRSGKTEAVPNPATGEVLAYVPISSREELDEAVRAAKEAFKTWRKTPVPRRARI
ref|NP_243178.1|       GGQWVESDSGKTEAVPNPATGEILAHVPISNREDLDRAVSVAKEAFKTWGKTPVPRRARV
RAAC02441              GGAWRDAEASEYLDVFDPATAEVIAQVPLSTQQDVEMAVAAAAEAFREWSKTPVPRRARI
                       ** *   :  :.:    * :***.*::* **:*.::::: **.*.***: *.*.*******:

ref|YP_147804.1|       LFRYQQLLVEHWDELARLVTLENGKVYEDAYGEVQRGIECVEFAAGIPTLMMGQQLPDIA
ref|YP_001125954.1|    LFRYQQLLVEHWEELARLVTLENGKVYEDAYGEVQRGIECVEFAAGIPTLMMGQQLPDIA
ref|YP_001125911.1|    LFKYQQLLVEHWEELARLVTLENGKSYNEAYGEIQRGIECVEFAAGAPTLMMGRQLPSIA
ref|YP_147740.1|       LFKYQQLLVEHWEELARLVTLENGKSYNEAYGEVQRGIECVEFAAGAPTLMMGRQLPDIA
ref|NP_243178.1|       LFKYQQLLVENWEELARLVTLENGKSYKEAYGEVQRGIECVEFAAGAPSLMMGKQLPDIA
RAAC02441              FFRYQQLLVDHWDELARLIVRENGKSYKDAYGEVQRAIENVEFAASAPTLLMGEQLANIA
                       :*:******::*:*****:. **** *::****:**.** *****. *:*:** **..**

ref|YP_147804.1|       TDIESGMYRYPLGVVAGITPFNFPMMVPCWMFPLAIACGNTFVLKPSERTPMLANRLAEL
ref|YP_001125954.1|    TGIESGMYRYPLGVVAGITPFNFPMMVPCWMFPLAIACGNTFVLKPSERTPLLANRLAEL
ref|YP_001125911.1|    TGIESGMYRYPIGVVGGITPFNFPMMVPCWMFPLAIACGNTFVLKPSERTPMLANRLAEL
ref|YP_147740.1|       TGIESGMYRYPIGVVGGITPFNFPMMVPCWMFPLAIACGNTFVLKPSERTPMLANRLAEL
ref|NP_243178.1|       TNIESGMYRYPIGVVGGITPFNFPMMVPCWMFPLAIACGNTFVLKPSERTPLLANRLAEL
RAAC02441              TSLDSGMYRYPLGVVAGITPFNFPMMVPCWMFPLAIVCGNTFVLKPSERTPLLAQRLAEL
                       *.::****:*.****************.**********::***** ref|YP_147804.1|       FTEAGLPPGVLNIVHGAHEVVGGILEHKDIKAVSFVGSQPVAEYVYKTAAAHGKRVQALA
ref|YP_001125954.1|    FTEAGLPAGVLNIVHGAHEVVNGILEHKDIKAVSFVGSQPVAEYVYKTAAAYGKRVQALA
ref|YP_001125911.1|    FKEAGLPDGVLNIVHGAHDVVNGLLEHPDVKAISFVGSQPVGEYVYKTAAAHGKRVQALT
ref|YP_147740.1|       FKEAGLPDGVLNIVHGAHDVVNGLLEHPDVKAISFVGSQPVAEYVYKTAAAHGKRVQALT
ref|NP_243178.1|       FTEAGLPEGVLNIVHGAHDVVNGLLEHPDVKAISFVGSQPVAEYVYKTASQHGKRVQALA
RAAC02441              LEEAGLPSGVLNIVHGAREVVQGLIEHPTVRAISFVGSQPVAAYVYREAAAHGKRVQALA
                       : ***** *********:.** *::**  ::*:********. ***: *: :*******:

ref|YP_147804.1|       GAKNHSIVMPDADLDMAVTNIINAAFGSAGERCMACSVVVAVGDIADELVRRLKEAADRI
ref|YP_001125954.1|    GAKNHSIVMPDADLDMAVTNIINAAFGSAGERCMACSVVVAVGDIADELVERLKKAADRI
ref|YP_001125911.1|    GAKNHSIVMPDADLKVAVREIINAAFGSAGERCMAASVVVAVGDIADELVERLVAAANEI
ref|YP_147740.1|       GAKNHSIVMPDADLNVAVREIINAAFGSAGERCMAASVVVAVGEIADELVEKLVAAANEL
ref|NP_243178.1|       GAKNHSIVMPDADLDGAVNQIVNAAYGSAGERCMAAVVVAVGEVAEPLMEKLQKAVNEI
RAAC02441              GAKNHTIVMPDADLDEAIPQIISAAFGSAGERCMACSVVVAVGSIADRLVEGLKSAADQI
                       *****:********.  *: :*:.**:*********.:*****.:*: *:.  *.:.:

ref|YP_147804.1|       QIGNGLDKGVFLGPVIRESHKERTIKYIEIGEKEGALLVRDGRRDSATSGQGYFIGPTIF
ref|YP_001125954.1|    QIGNGLDQGVFLGPVIRESHKERTIKYIEIGEREGALLVRDGRRDAATSGKGYFVGPTIF
ref|YP_001125911.1|    KIGNGLEESVFLGPVIREAHKQRTVNYIELGEKEGAILVRDGRKDAAVQGEGYFIGPTIF
ref|YP_147740.1|       KIGNGLEESVFLGPVIREAHKQRTVKYIELGEKEGAILVRDGRKDAAVQDNGYFVGPTIF
ref|NP_243178.1|       TIGNGLDDDVFLGPVIRESHKQKTENYIELGEKEGATLVRDGRKDNVSKD-GYFLGPTLF
RAAC02441              RIGNGLDEDVLLGPVIRAEHRDRTLQYIDLGIQEGAVLVRDGRQDRVDAN-GYFVGPTIF
                       ****:...:******  *::* :**:* :*** ******:*  . .***:***:*
```

FIG. 80B

```
ref|YP_147804.1|        DHVKPGMTIWTDEIFAPVLSVVRARDLDEAIEIANRSEFANGACIYTDSAKAIRQFREEI
ref|YP_001125954.1|     DHVKPGMTIWTDEIFAPVLSVVRARDLDEAIEIANRSEFANGACIYTDSAKAIRQFREEI
ref|YP_001125911.1|     DRVTTDMTIWKDEIFAPVLSIVRVSTLDEAIEVANKSPFANGACIYTRDGGNVRKFRDEI
ref|YP_147740.1|        DRVTTDMTIWKDEIFAPVLSIVRVETLDEAIEVANKSPFANGACIYTRDGGNVRKFREEI
ref|NP_243178.1|        DNVTTEMTIWKEEIFAPVLSVVRVESLDEAIQLTNQSEFANGACLYTTNGSSVRKFREEI
RAAC02441               DHVRPSMKIWQDEIFAPVLSVVRVGTLDEAIALANRSRFANGACIFTNSASAIRKFREEI
                        *.*  . *.**  :********:**.   *****  ::*:* ******::*  ..  :*:**:**

ref|YP_147804.1|        DAGMLGVNVAVPAPMAFFPFSGYKNSFYGDLHANGRDGVEFYTRKKMVTAR-
ref|YP_001125954.1|     DAGMLGVNVAVPAPMAFFPFSGYKNSFYGDLHANGRDGVEFYTRKKMVTAR-
ref|YP_001125911.1|     DAGMLGVNLGVPAPMAFFPFSGWKNSFYGDLHANGMDGVEFYTRKKMLTAR-
ref|YP_147740.1|        DAGMLGVNLGVPAPMAFFPFSGWKNSFYGDLHANGMDGVEFYTRKKMMTSR-
ref|NP_243178.1|        DAGMLGINLGVPAPMAFFPFSGWKNSFYGDLHANGTDGVEFYTRKKMITAR-
RAAC02441               DAGMLGVNIGVPAPMAFFPFSGWKDSFYGDLHANGKDGVAFYTRRKMITARV
                        ******:*:.************:*:********* *** ****:**:*:*
```

FIG. 81

```
ref|YP_001125956.1|    ------ELLVPNRVIYGRDTFREVGRQAKALGTKALIVSDPVMENIGLVARCEQYLREAG
ref|YP_147805.1|       ------ELLVPSRVVYGRDTFAEVGPQAKALGTKALIVSDPVMEKIGLVARCEQYLQQVG
RAAC02442              MSRVFGEFKVPEAVYAGRGALQMLPQASSSLGKRALIVTDEVMERLGYVAQMQRMLAEAG
ref|NP_831941.1|       ------EFRMPKSVLYGRNSLEKLGEQSKKLGKRAFIVTDTIMEKLGYVEKCMQQLNKKG
ref|ZP_01169177.1|     -------FRVPESIFYGRGSFENLGSQAALKGKKALIISDNVMDQLGYVTEGRALLHVAG
ref|ZP_01695873.1|     -------FRTPQTILYGKQAFEKIGEEAARRGKKALIVTDKIMAGLGNADACQHILQEAG
                             :  *. :   *: ::     :      *.:*:*::* :*  :* .     *    * ref|YP_001125956.1|    LPLATYTRVDTEPTDVHVKEALDVCRSEQCDVIVAIGGGSSIDAAKAVAVMMTNEGTISD
ref|YP_147805.1|       MTFAKYTGVDTEPTDVHVKEALDVCRSEQCDVIIALGGGSSIDAAKAVSVMMTNEGTISD
RAAC02442              VQADVFAEVNTEPTDVHVETGVRAFLQHGCDHLIALGGGSAIDAAKGISVMAVHEGYIGD
ref|NP_831941.1|       ITVSTYNKVDAEPTNIHVLEALSLCKEEKCDFIIGIGGGSCIDAAKAVAVLYTNGGEVED
ref|ZP_01169177.1|     VQSEVYLGIASEPTDKYVSEALDLFKSEQCDLVISIGGGSCIDTAKAIAVLAVNGGSIGD
ref|ZP_01695873.1|     VKSAVYAGVNSEPVDHYVSEALALFQQESCDLLVSLGGGSCIDTAKAVAVVATNGGYIGD
                        :      :  :**.: :*    .:    ..    ::.:.:**.::*:  .: *  : * ref|YP_001125956.1|    YVGNAKMFTKKPVPLIAIPTTAGTGSEVTKVTVIIDTKTDVKMMISQPALLPAVAIVDPL
ref|YP_147805.1|       YVGNQKRFTEKPLPLIAIPTTAGTGSEVTKVTVIIDTKMDVKMMISQPALLPAVAIVDPL
RAAC02442              YMGGRRTFDKAPYPVIAIPTTAGTGSEVTSVTVITNTKDDVKMMIRQPALLPKVAIVDPQ
ref|NP_831941.1|       YVQKDIKIENKPLPLIAIPTTSGTGSEVTSVAVITNKKTDVKMMMKHPSFIPKVAIIDPV
ref|ZP_01169177.1|     YLGGKKLAQQTPVPHIAIPTTAGTGSEATDVTVITNTFNNVKMMIKQPAFLPDAAIVDPL
ref|ZP_01695873.1|     YMGARKIAEKPPVAHIAVPTTAGTGSEATDATIITNTANDVKMMIKQPAFMPAVAIVDPV
                       *:         : *   . **:***:*****.*..::*  :..     :****:  :*:::*  .**:**

ref|YP_001125956.1|    LTVSCPPSVTAATGVDALCHSIEAYISRRAHPVTDVLALSAIEAIIGHLRRAYENGQDIE
ref|YP_147805.1|       LTVSCPPSVTAATGVDALCHAIEAYISRRAHPVTDALALSAIEAIVGHLRRAYENGQDIE
RAAC02442              LTVSSPPHVTASSGVDALCHAIEAFISRRSHPLTDALATDAAKKIVTYLERAYNDGQDLE
ref|NP_831941.1|       LTSSLPPQITAATGIDALCHAIEAYISKFSQPLTDVLALSAIESIMKYLRIAYEDGRNME
ref|ZP_01169177.1|     LTVSSPKNITAATGIDALSHAIEAYLSKKAHPMTDTMAISAMKLIAENILTAYNDGGNLD
ref|ZP_01695873.1|     LSKSSPKSVTAATGVDALSHAIEAYISRRAHPLTDTLALSAMRLIIPNLKSAYEDGENME
                       *:  *  *   :**:*:****.*:****::*:   ::*:**.:*  .*   *      :   **::*  :::

ref|YP_001125956.1|    AREKMAIAAMKAGMAFSNASVTLVHGMSRPIGALFHVPHGVSNAMLLPGVLEFTKESAIE
ref|YP_147805.1|       AREKMAIAAMKAGMAFSNASVTLVHGMSRPIGALFHVPHGVSNAMLLPGVLEFTKDSAIE
RAAC02442              AREGMAIAALEAGMAFTNSSVCLVHGMSRPIGALFHVPHGFANAMLLPTVLEFRLDDYAP
ref|NP_831941.1|       AREAMMIASLQAGIAFSNASVTLVHGMSRPVGALFHVPHGISNAILLPTVLEFTKTSAMK
ref|ZP_01169177.1|     ARERMSLGSLQAGMAFSNASVCLVHGMSRPIGALFHVPHGISNAMLLPAVLEFSQEACVE
ref|ZP_01695873.1|     ARDAMALGSLQAGMAFSNASVCLVHGMSRPIGALFHVPHGVSNAMLLPAVLEFSKSVCLE
                       **:  *   :.::::: ****:*****.:.* ** ref|YP_001125956.1|    RLAVIARLINPQLKDVSNAEAADALVEEVKQLCRDLHIPNMKTWGIDKTAFDKAVDKMAA
ref|YP_147805.1|       RLAVIVRIIKPPLKDVSDTEAAEALVEEVKQLCRDLHIPNMKTWGIDKTAFDKVVDKMAA
RAAC02442              RLALLARALNPELSGASDGEAAAWVVRRVKTLAERLQIPNLKTWGIERDAFERALDKMAN
ref|NP_831941.1|       RLAKIGRSLNKDLYSNSDEEVADYTLGEIKKLCFDLRIPNLKEYGIDEIEFENAISKMAS
ref|ZP_01169177.1|     RLADIGRIFRPDIVSGDGVKAAEIAVQSVKELCRKLNIPNLKEWGIDGEAFEKAVGKMAA
ref|ZP_01695873.1|     RLADIGKIFSPEAKDLSGKEAADLAVRAVKQLCLDLNIPNLRGWGIPQQPFESAINKMAS
                       ***  :  :          . .. :.*     :  :* *.  *.*::   :       *:  .:.*** ref|YP_001125956.1|    DALASGSPSNNPRVPTHEEIVALYHICYDYRYD---------
ref|YP_147805.1|       DALASGSPANNPKVPTHEEIVALYHYCYDYQYDTKTVSS---
RAAC02442              DALASGSPANHPVVPSHEEIVQLYRQAYDATWDAAPMESLTK
ref|NP_831941.1|       DAIESGSPANNPRVPSYDEIKELYRECFN------------
ref|ZP_01169177.1|     DAIDSGSPANNPKVPSQLELEELYHICYDYHFSSA-------
ref|ZP_01695873.1|     DALASGSPQNNPRVPSQKEIEDLYLVCYD------------
                       **: ****  *:* **   *:   **     .::
```

FIG. 82A

```
ref|YP_723673.1|        --------KVLVSDSIDQNGINILS--QVAQVDIKIGLPVEELVKIIPEYDGLMIRSGTK
ref|ZP_01623360.1|      --------KVLVSDSIDPAGIDILS--QVAQVDVKTGLPAEELVKIISEYDALMIRSGTR
ref|YP_686117.1|        --------KVLVTDPISEEGIKILKSEPGVQVDIETRLTKEQLIEKIKDYNALIIRSETQ
ref|YP_001111391.1|     --------KVLVMDGVSEQGLAPLRQHTDIEVVIGEKMTEDQLVEVIGEYDAMIVRSATK
RAAC02630               MVRENMATKILVTDDISQAGIDILSGLQGAEVVVRTNLAPDELKEAIADADALVVRSQTR
ref|ZP_01695367.1|      ---------ILVTDKVSEEGLKKLYAHKDFIVEHQPGIAPEDLKATIGQYDGLIVRNQTK
                                 :** * :. *: *        *   :. ::*  * : :.::::*. *:

ref|YP_723673.1|        VTKEIIEAADKLKIIGRAGVGVDNVDVQAATRKGIVVVNSPEGNTIAAAEHALAMMLSMS
ref|ZP_01623360.1|      VTQEIIEAGVQLKIIGRAGVGVDNVDVAAATRAGIVVVNSPEGNTIAAAEHALAMMLSLS
ref|YP_686117.1|        VTKEVIAAGKNLKIIGRAGVGIDNVDVPAATEKGIIVVANAPEGNTIAACEHTLSMMLAMS
ref|YP_001111391.1|     VTPRVVEAAKKLKVIGRAGVGVDNIDRNAATNKGIVVVNAPDGNTIAAAEHTMAMMLGLA
RAAC02630               VTRDVIESAKKLKVIGRAGVGVDNIDLEAATRRGILVINAPDGNTIAAAEHTFAMMISLA
ref|ZP_01695367.1|      VTKDIIEASGNLRVIARAGVGVDNIDVDAATRKGIIVVNSPGGNTISATEHTLAMMLSLS
                        **  ::  ::.  :*::*.****:**:*  ***. **:* *:* ****:*  **:::**:.::

ref|YP_723673.1|        RHVPEANQSIINAQWDRKKFVGVEVYKKTLGVVGLGKIGSHVAKVAKAMGMKILAYDPFI
ref|ZP_01623360.1|      RYIPEANQSVKSGKWDRKKFIGVEVYKKTLGIVGLGKIGSHVAAAAKAMGMKLLAFDPYI
ref|YP_686117.1|        RNIPQANASLKSGKWERSKFMGVEVMNKTLGIIGLGRIGGEITKRARSFGMEVLAYDPFT
ref|YP_001111391.1|     RKVPAACGKLKNGIWDKKAFLGVELRGKTLGVIGLGRIGTAVAKRAQAMEMNIVAYDPYI
RAAC02630               RHIPAAHRDLLQGNWNRKKWIGVELRGKTLAVLGMGRIGTEVAKRAKAFGMTVLGYDPFL
ref|ZP_01695367.1|      RNIPQAHKSAAAGKWEREKFKGVELFKKTLGIIGTGKIGTEVAKRAKAFGMAVLGYDPYL
                        * :* *  .   .  *::. : *** ***.::* *:**  ::  *:::  *  ::.:**:

ref|YP_723673.1|        SEERAEQLGCSLVDLDLLVQESDYITLHIPKTDETYHSINAETFAKMKPTARIINCSRGG
ref|ZP_01623360.1|      SQERADQLSCRLVDLELLLQESDYITLHMPKTKDTYHMIDAKAFEKMKPTARIINCARGG
ref|YP_686117.1|        TAERAQQIGARLTTLDEIYEKADFITVHTPLTPSTKHMVSTAQFEKMKKGVRIINCARGG
ref|YP_001111391.1|     SEDHARKMAVEIVTLQELFKRADFITIHMPKTKETYHMINEEALELMKDGVRIINCARGG
RAAC02630               TEERAQSLGVKRCDLDTAIREADFITVHTPLTKETHHMIDAGRIAQMKEGVRIINCARGG
ref|ZP_01695367.1|      TEERAAKLGIKKATLDEIAAQADFITLHTPLMKETKHLINEAFLAKTKKGVRIINCARGG
                        : ::*  .:.   *: .:*:**:*   .*  * :.    :   * .***:* ref|YP_723673.1|        IIDEVALSKALKEGKIAGAALDVYENEPLEVESPLRDLGQKIVMTPHLGASTAEAQVNVA
ref|ZP_01623360.1|      IIDEAALVEALKQGQIAGAAIDVYENEPLEAESPLRALDQKLVLTPHLGASTEEAQVNVA
ref|YP_686117.1|        IIDEAALLEAIKSGKVAGAALDVFEKEP-PVGSPLLEQ-PNIIVTPHLGASTAEAQINVA
ref|YP_001111391.1|     IVDEEALYKFMEAGKVAGAALDVFETEPC-TDNPLLKL-DNFIATPHLGASTQEAQINVA
RAAC02630               IIDEVALAEALEAGRVAGAAIDVFEQEPLPMDHPLRRC-PNVVLTPHLGASTVEAQENVA
ref|ZP_01695367.1|      LVDEQALLQALQEGRVAGAALDVFENEP-DITPGLLEL-PNVTVTPHLGASTREAQVRVA
                        ::** **  :  ::  *::****:**:*  **        *   :. ******** *** .**

ref|YP_723673.1|        IDVAEQIRDVLLGLPARSAVNIPGMYPDTLKKLKPYLRLAETLGNLVSQLAGGRIDFLNV
ref|ZP_01623360.1|      VDVAEQIRDVLLGLPARSAVNIPGLYPDALEKLKPYLQLAETLGNLVSQLAGGRVDFLDV
ref|YP_686117.1|        ITIAEQVLNAFKGLPVTTAINIPIMKPEVMEKVKPFLPLAEQLGKFAAQITDGQIKEAIV
ref|YP_001111391.1|     VDVAEEIVAALRGDLVKNAVNMPSMSPKLLAKIRPFLDLAEKLGTFQAQMLDGRIEKVEV
RAAC02630               IQVAEEIVQVLRDDTFEHAVNLPSLSQRQKERLAPYLALAEQLGLFAAQLAQGAPSSMTV
ref|ZP_01695367.1|      ADVSDEIIHIFESEEIRNAINMPQTSGENRERMEPFLLLGEQVAQLGIQLLDEAPEKIEI
                        :::::  :  .    *:*:*  ::  *:* *.*  :. :      .   :

ref|YP_723673.1|        RLEGDLAGGDSKPVVVGALKGLLSQALRERVNYVNAFIEAKERGIRVVETRDDSVRDYTG
ref|ZP_01623360.1|      RLQGELATNNSQPVVVASLKGLLSQALRERVNYVNASIEAKERGIHVIETRDASANDYTG
ref|YP_686117.1|        SYNGEIAQKDVTLVTVAVLKGLLDVKLGEPVNYVNAKHIAKDRSINVAETKLAETGDYTN
ref|YP_001111391.1|     VYSGELAKYDVNPVTTILLKGLLDPILQENVNFVNATLVARNRGISVVQTTKENGEDYHN
RAAC02630               RYAGDAADPDGGYLTRTVLKGFFSFQYNGEVNYVNALRYAEDAGLRVQEVRESRGRVYTN
ref|ZP_01695367.1|      TYAGELLDEDTKLLTRTIIKGILARHLGSTVNLVNALHLLKEQGLTYNLQRNAAFKGFSN
                        *:    :    :.   :**::    ** ***    .:  .:
```

FIG. 82B

```
ref|YP_723673.1|      SLHLEAKGSLGEHNVRGSLLGKDEIRITNIDGFPINVPPSPYMLLTLHRDMPGIIGKIGS
ref|ZP_01623360.1|    SLHLEAKGSLGTHSVTGALLGSSEMRITNIDGFPINVPPTHHMLFTLHRDMPGIIGKIGS
ref|YP_686117.1|      LITLTLKTDKGETRVSGTIFGKSDARIVEIQGYRVDAVPSGTMIVTRHQDRPGVIGKVGM
ref|YP_001111391.1|   LITVYIYTDKGRRMLSGTLFQGNDPRIVNIDGFRINAATQGHMLVVPHIDKPGIVGKVGT
RAAC02630             EVEISVATDNGTHRVTGTVLGEYGPRIVELDGYPIDTPIQGILIYTRHEDRPGMIGRIGT
ref|ZP_01695367.1|    YLELALYKKGKQVNIGASIINGFGGRIVKLNDYRVDLRPEQHLLYIRHLDIPGMIGQVGS
                       : :       .      :  .::    **.:::.: ::          ::    * *  **::*::* ref|YP_723673.1|      LLGSFNVNIASMQVGRKIVRGDAVMVLSVDDPLPEEILTEILKEPGIRNAYTVAL
ref|ZP_01623360.1|    LLGSFNVNIASMQVGRKIVRGEAVMVLSIDDPLPEGLLSEIMKVPGIR-------
ref|YP_686117.1|      ILGKLNINISGMVVGRDAVRGDAVMILTVDDEVPAATLKQM--------------
ref|YP_001111391.1|   VVGDMAINIAGMQVGRIELGGKAIMVMMVDNTLPTNALEQLATIDGILEVKMVSL
RAAC02630             LLGDRDINIAGMQVGRRETGGEAVMLLSVDKRVPQDVIDEIAKHPGIRLVRAIEL
ref|ZP_01695367.1|    ILGSNDTNIGTMQVGRKEIGGEAIMVLTLDKTASRQVLDQLKEVIGIKAVQTLEL
                      ::*.    **.  * ***         *.*:*::  :*.   .    :   ::
```

FIG. 83

```
ref|YP_009822.1|        ------------------MNRIAVIGVGNVGMAFAYAAAIKRLANDIVLIDANAARAEG
RAAC02644               --MTIR------------LTRIVIIGVGSVGTATAYTLYLRERASEVVLIDADMQKAEG
ref|NP_782567.1|        ------------------KISIIGSGFVGSTTAYALMMEGLASEIVIVDINKEKAKG
sp|Q892U0|LDH_CLOTE     ------------------KISIIGSGFVGSTTAYALMMEGLASEIVIVDINKEKAKG
ref|YP_590559.1|        ------------------RIAVVGLGNVGASFAFALLQRRLAAEIVLIDANHKKAEG
ref|ZP_01514103.1|      ------------------RTGKVGVVGTGMVGTSFAYALMQRSLASELVLIDIDRARAEG
                                           ::  ::* * ** : *::   . * ::*:**   :  :*:* ref|YP_009822.1|        ESMDLADAMALVGPVQIRSGGYEQCEGARIVVVTAGAKQMPGQSRLDLVRVNAGITRDIL
RAAC02644               EALDMQHGSIYCGGTKIRAGTYEDCATADIVIVTAGVAQRPGQSRIDLLVKNIQVIQDIS
ref|NP_782567.1|        EAMDLSHGVSFVKPVDIIAGDYEDTKDSDIVIITAGAGPKPGETRLDLINKNYEIFKGIV
sp|Q892U0|LDH_CLOTE     EAMDLSHGVSFVKPVDIIAGDYEDTKDSDIVIITAGAGPKPGETRLDLINKNYEIFKGIV
ref|YP_590559.1|        EAMDLNHAVPFGAATRIWAGEYADCRGAAVTVITAGAAQRPGETRLQLLDRNLAIFQQIV
ref|ZP_01514103.1|      EAMDLNHGLPFVRPMRIYAGDYADLADADLIVIAAGANQRPGETRLDLLGRNAAIFRDMI
                        *::*:  ..          * :* * :    : : :::**.  **::*::*:  *    : : :

ref|YP_009822.1|        TAVMQYADDPLYIMATNPVDVLTHVARTVTGVAPGRVIGSGTVLDSARFRGHVAEILGVD
RAAC02644               FKLKQYGFNGILIVASNPVDILSYVAWYISGLPSERVIGSGTVLDSLRFRYYLGRELGVD
ref|NP_782567.1|        PEVVKYSPKSILLVVSNPVDILTYVTYKLSGFPQERVIGSGTVLDTSRFRYLLGEHFKID
sp|Q892U0|LDH_CLOTE     PEVVKYSPKSILLVVSNPVDILTYVTYKLSGFPQERVIGSGTVLDTSRFRYLLGEHFKID
ref|YP_590559.1|        PEVVKHNPDGLLLIATNPVDIISYASYKISGLPAHRVLGSGTILDTARFRYLLGQHFSVD
ref|ZP_01514103.1|      PAILAANHDGIIVVATNPVDILTTIAAQIAGSDANRVIGSGTILDTARFRYLLGQHYGVD
                         :          . : ::.:****::::   :  ::*    ::: ***  :..    :* ref|YP_009822.1|        VRGVHAHIVGEHGDSEVALWSRANVSGIPVAEMCARRGIAYDAAFREKALGHVRHAAYEI
RAAC02644               PGSVHAQVLGEHGDTQVHIWSSLNVGGVQVPISERIRGVED---------HTRRAAYEL
ref|NP_782567.1|        VRNVHTYILGEHGDSEIAAWSLTNIAGISVEDYCKDICKGCEGNFKNRIPEEVKNAAYEV
sp|Q892U0|LDH_CLOTE     VRNVHTYILGEHGDSEIAAWSLTNIAGISVEDYCKDICKGCEGNFKNRIPEEVKNAAYEV
ref|YP_590559.1|        ARSVHGLILGEHGDTEVPIWSLANIAGIRLREYCRLHSLPYDEHVFDTIFTDTRDAAYKI
ref|ZP_01514103.1|      PRSVHAYIVGEHGDSELALWSLANIAGVRLVDFVGANGQGYDQAALDAILEQTRNAAYEI
                         .** ::*****::  **  *:.*:  :                      ...: ***::

ref|YP_009822.1|        IGRKGATGYGIGMSLCRIVEAILHDEHSVLTVSCPVAGHYGLGDVSLSLPCVIGSDGIEE
RAAC02644               IEHKGYTNYGIALVLDAICEAILQDKHTVLTVSTKVAEYHGVSDVYLSVPCVIGVRGIER
ref|NP_782567.1|        LERKGYTSYAIALAVRRIVEAIIRDEDSILTVSTLLRGEYGINDIYMGIPSVIGETGIKR
sp|Q892U0|LDH_CLOTE     LERKGYTSYAIALAVRRIVEAIIRDEDSILTVSTLLRGEYGINDIYMGIPSVIGETGIKR
ref|YP_590559.1|        IERKGATYYAVAVGLMQIVESIVRDQKTVLTTSTLVEGAYGINDVYLSLPTIVGAKGVVQ
ref|ZP_01514103.1|      IKRKRATYYAIGLGLLAIAEAVLRDQHTVMTVSSLMTGQYGVTDIAISLPTIVGRDGAEE
                        : :*  *  *.::  :  * *:::*:*:.::**.*  :   :*: *:  :..* ::*  *  .

ref|YP_009822.1|        VLDAPIAEDEQAALAASARVL------------------
RAAC02644               VIEVPMSDMEERVFQESAKHLYNATREAIRIIGWRES
ref|NP_782567.1|        VLEVKLSKDEEKQLKESAEVL------------------
sp|Q892U0|LDH_CLOTE     VLEVKLSKDEEKQLKESAEVL------------------
ref|YP_590559.1|        VLTPDLSEEELAKLQHSAEVL------------------
ref|ZP_01514103.1|      VLNLPLSDHEVALFQRSANLL------------------
                        *:   ::. *   :  **. *
```

FIG. 84A

```
ref|YP_001124710.1|    ----------------SFAER--VRQLEESWKNEERWKGVVRPYSAEDVIKLRGSLDIEH
ref|YP_146529.1|       ----------------SFAER--VRQLEESWKNEERWKGIVRPYSAEDVIKLRGSLDIEY
ref|YP_893868.1|       -------------------------KLQESWELDTRWKGITRPYSAEDVIRLRGSIDIEH
ref|NP_843617.1|       -------------------------KLQESWELDTRWKGITRPYSAEDVIRLRGSIDIEH
ref|NP_977551.1|       -------------------------KLQESWELDTRWKGITRPYSAEDVIRLRGSIDIEH
RAAC02702              ----------------MTYFKTAAELEQHWKTDPRWKGVERAYTAEDVIRLRGSVHIEH
                                       :*:: *: : ****: *.*:*****:****:.**:

ref|YP_001124710.1|    TLARRGAEKLWKLLNTEDYVHALGALTGNQAVQQVKAGLKAIYLSGWQVAADANLAGHMY
ref|YP_146529.1|       TLARRGAEKLWKLLHTEDYVAALGALTGNQAVQQVKAGLKAIYLSGWQVAADANLAGQMY
ref|YP_893868.1|       TLARRGAEKLWASLHTEDYINALGALTGNQAMQQVKAGLKAIYLSGWQVAADANLSGHMY
ref|NP_843617.1|       TLARRGAEKLWASLHTEDYINALGALTGNQAMQQVKAGLKAIYLSGWQVAADANLSGHMY
ref|NP_977551.1|       TLARRGAEKLWASLHTEDYINALGALTGNQAMQQVKAGLKAIYLSGWQVAADANLSGHMY
RAAC02702              TLAQMGAEKLWRGLHEDGFIRALGALTGNQAVQQVKAGLKAIYVSGWQVAADANLAEHMY
                       ***: ****** *: :.:: **********:***********:***********: :**

ref|YP_001124710.1|    PDQSLYPSNSVPHVVKRINQALQRADQIQYLEGSGDVDYFVPIVADAEAGFGGQLNVFEL
ref|YP_146529.1|       PDQSLYPSNSVPHVVKRINQALQRADQIQYLEGSGDVDYFVPIVADAEAGFGGQLNVFEL
ref|YP_893868.1|       PDQSLYPANSVPAVVKRINQTLQRADQIQHMEGSGDTDYFVPIVADAEAGFGGQLNVFEL
ref|NP_843617.1|       PDQSLYPANSVPAVVKRINQTLQRADQIQHMEGSGDTDYFVPIVADAEAGFGGQLNVFEL
ref|NP_977551.1|       PDQSLYPANSVPAVVKRINQTLQRADQIQHMEGSGDTDYFVPIVADAEAGFGGQLNVFEL
RAAC02702              PDQSLYPSNSVPSLVRRINNALLRADQIQTAEGKGDIDWMVPIVADAEAGFGGPLNVFEL
                       *****:** :*:***::* **** .** *::*********** **** ref|YP_001124710.1|    MKAMIEAGAAGVHFEDQLSSEKKCGHLGGKVLLPTQTAVRNLIAARLAADVMGVPTVLIA
ref|YP_146529.1|       MKAMIEAGAAGVHFEDQLSSEKKCGHLGGKVLLPTQTAIRNLIAARLAADVMGVPTVLIA
ref|YP_893868.1|       MKGMIEAGASGVHFEDQLSSEKKCGHLGGKVLLPTQTAVRNLISARLAADVMGVPTIIVA
ref|NP_843617.1|       MKGMIEAGASGVHFEDQLSSEKKCGHLGGKVLLPTQTAVRNLISARLAADVMGVPTIIVA
ref|NP_977551.1|       MKGMIEAGASGVHFEDQLSSEKKCGHLGGKVLLPTQTAVRNLISARLAADVMGVPTIIVA
RAAC02702              MKMMIEAGAAGVHFEDQLSSEKKCGHMGGKVLIPTSHAVRNLTAARLAADVLGVPTVIVA
                       ** ******:****************:*****:**. *:*** :******:****::: *
```

FIG. 84B

```
ref|YP_001124710.1|    RTDANAADLITSDIDPRDQQFITGERTTEGFYRTRAGLDQAIARGLAYAPYADLIWCETS
ref|YP_146529.1|       RTDANAADLITSDIDPRDQAFITGERTPEGFYRTRAGLDQAIARGLAYAPYADLIWCETS
ref|YP_893868.1|       RTDADAADLITSDIDPVDKAFITGERTPEGFYRTKAGLDQAIARGLAYAPYADLVWCETS
ref|NP_843617.1|       RTDADAADLITSDIDPVDKAFITGERTPEGFYRTKAGLDQAIARGLAYAPYADLVWCETS
ref|NP_977551.1|       RTDADAADLITSDIDPVDKAFITGERTPEGFYRTKAGLDQAIARGLAYAPYADLVWCETS
RAAC02702              RTDANGAFLITSDVDDRDARFITGERTPEGFYRFRGGLEAAIARGLAYAPYADMIWCETS
                       ****:.* *****:*  *  *******.*****  :.**: *************::****

ref|YP_001124710.1|    EPNLDEARRFAEAIHEQFPGKLLAYNCSPSFNWKKKLDDETIAKFQQELGKMGYKFQFVT
ref|YP_146529.1|       EPNLDEARRFAEAIHEKFPGKLLAYNCSPSFNWKKKLDDETIAKFQQELGKMGYKFQFVT
ref|YP_893868.1|       EPNLEDAKRFADAIHKEHPGKLLAYNCSPSFNWKQKLDEKTIASFQKEIASYGYKFQFVT
ref|NP_843617.1|       EPNLEDAKRFADAIHKEHPGKLLAYNCSPSFNWKQKLDEKTIASFQKEIASYGYKFQFVT
ref|NP_977551.1|       EPNLEDAKRFAEAIHKEHPGKLLAYNCSPSFNWKQKLDEKTIASFQKEIASYGYKFQFVT
RAAC02702              EPNIEEAKRFAEAIKAEFPDKLLAYNCSPSFNWRKKLDPKTIEEFQEIIASFGYKFQFVT
                       ***:::*:*:: :.*.**********::*  : .: :..  ******* ref|YP_001124710.1|    LAGFHALNYSMFELARGYKDRGMAAYAELQQAEFAAEKYGYTATRHQREVGTGYFDEVAQ
ref|YP_146529.1|       LAGFHALNYSMFELARGYKERGMAAYAELQQAEFAAEKYGYTATRHQREVGTGYFDEVAQ
ref|YP_893868.1|       LAGFHSLNYGMFELARGYKERGMAAYSELQQAEFAAEKHGYSATRHQREVGTGYFDEVAQ
ref|NP_843617.1|       LAGFHSLNYGMFELARGYKERGMAAYSELQQAEFAAEKHGYSATRHQREVGTGYFDEVAQ
ref|NP_977551.1|       LAGFHSLNYGMFELARGYKERGMAAYSELQQAEFAAEKHGYSATRHQREVGTGYFDEVAQ
RAAC02702              LAGFHALNYSMFELAYGYNQRGMGAYSDLQQQEFAAEARGYTATRHQREVGTGYFDEVAQ
                       ***.*.*** ::*.::* *  :***************** ref|YP_001124710.1|    VI---------------------
ref|YP_146529.1|       VI---------------------
ref|YP_893868.1|       VI---------------------
ref|NP_843617.1|       VI---------------------
ref|NP_977551.1|       VI---------------------
RAAC02702              VVSGGLSSTTALTGSTEEEQFVEA
                       *:
```

FIG. 85A

```
ref|ZP_02080303.1|    --MRNVEKYTTQYFMPPVPCYDWTKKEYVEKAPIWCSVDLRDGNQALIVPMSLEEKLEFF
ref|YP_520543.1|      --MKNVDNYRRGYFMPPVKSLKWAEKEYITTPPTWCSVDLRDGNQALVVPMSLEEKLEYY
RAAC04058             MDMNNVNKYTRQYFLPPEPCFDWVHKDHVDRPPIWCSVDLRDGNQALIVPMNLEEKLAYF
ref|ZP_01966380.1|    -NMKNVTKYQRQYYMPPMKCMKWAEKEYVDKAPIWCSVDLRDGNQALVIPMSLEQKIEFF
ref|ZP_02073747.1|    LNMKNFEHYKRGYYMPPEKSVKWVEKEYIDKAPIWCSVDLRDGNQALIVPMNLDEKLEFF
ref|ZP_02039587.1|    --MKNFEKYERSYFMPPVPCYDWVKKDHIEKPPVWCSVDLRDGNQALIEPMSLEEKIEFF
                        *.*. :*   *::**    .*..*:::   .* ************: **.*::*: ::

ref|ZP_02080303.1|    KFLVEIGFKEIEVGFPAASETEYEFLRTLIERDMIPEDVTVQVLTQAREHIIRRTFEALE
ref|YP_520543.1|      HMLLKIGFKEIEVGFPAASETEYAFLRTLIEQNLIPEDVTIQVLTQSRDHIIEKTFKALV
RAAC04058             QLLVEIGFKEIEVGFPAASDTEFEFVRTLIERDLVPSDVTIQVLTQSRDHIIERTFEAIR
ref|ZP_01966380.1|    KLLVKIGFKEIEVGFPAASETEYTFVRTLIEQNLIPDDVTIQVLTQAREHIIRKTFEAVK
ref|ZP_02073747.1|    KELVRIGFKEIEIGFPAASETEYEFCRTLIEKNMIPDDVTIQVLTQARPHIIKKTFEAID
ref|ZP_02039587.1|    QMLLDVGFKQIEVGFPAASETEYQFLRTLIEQNMIPEDVTIQVLTQAREHIIKRTFEAVK
                      : *:  :****:**:******:**: * ***** :::*.***:*****:* ***.:**:*:

ref|ZP_02080303.1|    GCPRAIVHLYNSTSVAQREQVFRKSKEEIIRIAVDGAKLLQKISSEMGSDFRFEYSPESF
ref|YP_520543.1|      GVKKAVVHLYNSTSVAQREQVFKMSREEIVEIAVSGARLLKKYAAETEGNFQFEYSPESF
RAAC04058             GAKRAIVHLYNSTSVAQREQVFRADKDEIVNIAVTGAEQIRDLARTTPGNFFFQYSPESF
ref|ZP_01966380.1|    GAPKAIVHVYNSTSVAQREQVFKKSKEEILKIAVDGAKLLKELADETEGNFQFEYSPESF
ref|ZP_02073747.1|    GAKHAIVHLYNSTSYAQRTQVFKKSKEEILQLAVDGAKLLNQMAEEHGVNYPFEYSPESF
ref|ZP_02039587.1|    GAPHAVIHLYNSTSVAQREQVFKKNKEEIKKIAVDGAILLNELAKETEGNFTFEYSPESF
                      *  :*::*:***   * *: ..::  .:      :..  :: *:****** ref|ZP_02080303.1|    TGTEMEFARDICNAVLDVWKPTPEKKVIINLPVTVEHSMPHVYACQVEYMCKHLDYRDSV
ref|YP_520543.1|      TGTEMEFALEICNQVLDVFEPTPENKVIINLPATVSLSMPHVYASQIEYMSEHLKYRDNV
RAAC04058             TGTELDFALEICNAVLDVWKPTPDRKVIINLPATVELSMPHVYASQIEYMGKRLARRDAI
ref|ZP_01966380.1|    TGTEPEYALEVCNAVLDVWQPTPENKAIINLPVTVELSMPHVYASQIEYMSENMKYRENV
ref|ZP_02073747.1|    TGTEIDYALDVCNAVIKEWKPTPDRKVIINLPATVEMSLPHVYASQIEYMSEHLIDRENV
ref|ZP_02039587.1|    QGTEVDYALEVCNAVLRVWEPSRERKVIINLPTTVENAMPHVFASQVEYMSKHLYNREHV
                       ***  ::*  ::** *:    ::*: :.*.*****.**.  :*:***:*.*:*** :.:  *: :

ref|ZP_02080303.1|    VVSLHPHNDRGCGVADCELGLLAGADRIEGTLFGNGERTGNADIVTLALNMFSQGVDPKL
ref|YP_520543.1|      ILSLHPHNDRGTAVADAELGLLAGGQRIEGTLFGNGERTGNVDIVTLALNLFSHGVDPGL
RAAC04058             VLSVHPHNDRGTGVAAAELAMLAGAERLEGTLFGNGERTGNVDIVTLALNLYSHGIDPGL
ref|ZP_01966380.1|    ILSQHPHNDRGCGVADSELGLLAGADRVEGTLFGNGERTGNVDVVTLAMNMFAQGVDPEL
ref|ZP_02073747.1|    ILSLHPHNDRGCGVADAELGILAGADRIEGTLFGNGERTGNVDIITLAMNMFTHGVDPEL
ref|ZP_02039587.1|    LLSLHPHNDRGSGVSDAELGILAGADRIEGTLFGNGERTGNVDIITVAMNMYSQGVDPGL
                      ::* *******  .*:  ..:*  .*:************* .*::*:*:*:::*:** * ref|ZP_02080303.1|    NFEDMPSTVALYEKVTGMHVYDRQPYGGKLVFAAFSGSHQDAIAKGMKWREEKECDHWTV
ref|YP_520543.1|      NFASMLEITAKYEALTRMKVHDRQPYGGKLVFAAFSGSHQDAITKGIKWREEHECHYWNV
RAAC04058             DFSNLPAIQARVEALTKMQVSRRHPYAGELVFTAFSGSHQDAIAKGMKWREEKSPEHWTV
ref|ZP_01966380.1|    DFSDMPHICEVYEACTGMKVDERSPYSGALVFAAFSGSHQDAIAKGMHWRDEKDPNRWTV
ref|ZP_02073747.1|    DLSDIPKLTELYERVTNMHVYERSPYTGKLVFAAFSGSHQDAIAKGMKYRKDQGDGMWTV
ref|ZP_02039587.1|    DFSNMSEISETYERLTRMQVSPRQPYAGELVFTAFSGSHQDAIAKGMAWREEKQCQTWSV
                      ::  .:        *   * *:*   *  * *:******:. :*.::     *.* ref|ZP_02080303.1|    PYLCIDPKDIGREYEGDVIRINSQSGKGGIGYLLEQKYGFVLPPKMREDFGYAVKNVSDH
ref|YP_520543.1|      PYLLIDPQDIGREYEGDVIRINSQSGKGGIAYMLEQHYALDLPAKMREAFGYKVKNVSDN
RAAC04058             PYLPIDPKDIGREYEGDIIRINSQSGKGGIGYVLEQSHGFDLPPKMREQLGYAVKRVSDR
ref|ZP_01966380.1|    PYLPIDPTDVGRNYDADVIRINSQSGKGGVGYILETKYGLNLPPKMREAMGYAAKAVSDH
ref|ZP_02073747.1|    PYLPLNPEDIGRKYDGDVIRINSQSGKGGIGYILQSKYGFDLPPKFREDLGYTVKDVSDK
ref|ZP_02039587.1|    PYLPLDPKDVGRRYETDVIRINSQSGKGGVNYILKQSFGISLPQKMREEVGYLVKDVSDK
                      ***  ::* *:**.*:  *:************: *:*:   ..:  ** *:** .** .*  ***.
```

FIG. 85B

```
ref|ZP_02080303.1|      QHKELQPEEVYEIFRREYLNI-NDKISLVDFHFVR-NDCIH-AAVTVKIGGVEKEIKGDG
ref|YP_520543.1|        LHKELMPEEIKDIFFKEYVNI-ENPIKFLNFHFLN-HDDFQ-TTVTLEFKGEIQELSGEG
RAAC04058               EQKELSADEIAEIFMREFVNL-GQPLDLVELTGTDARGSHR-VRATVVWQGETVEIEGAG
ref|ZP_01966380.1|      CHKELHPDEIFNLFKSTFENV-VEPYSIDEVHFQQ-KDGGITTQVTSTFNGKTITTEATG
ref|ZP_02073747.1|      AHKELSATEVLDIFQSTYVNI-ENPVRMLECHFVQ-GDGI-STEITIMKYGEKKVYHGKG
ref|ZP_02039587.1|      AHKELTPDWVYHIFEDHYIHV-KTIFTVDECHFKQ-EDGI-LAEATIHHAGSDRVINGMG
                         :***  .  :  .:*    :  ::     . :    .    *    *     . * ref|ZP_02080303.1|      NGRLDAVSNAIKENLGIQYQDLTYTEHALEQGSKSRAAAYVGITGKDGRITWGVGVDSDI
ref|YP_520543.1|        DGRLDAISNALQARLGLSYSNLIYKEHALELGSKSQAVSYVGVTGPDGVIHWGCGIHTDI
RAAC04058               NGRLDALCHALEEGLGIRVANLTYKEHALEVGSGSRAVAYISVDDEEGNTHFGCGVDTDI
ref|ZP_01966380.1|      NGRLDAVSNALKKAYEMKFTLVTYQEHALEKSSSSKAIAYVGIQKPDGTLSWGAGVDPDI
ref|ZP_02073747.1|      NGRLDAVSNAIKKHFDIDFKIICYEEHALQVGSNSQAVAYVGLEGKDGTVTWGAGIKDDI
ref|ZP_02039587.1|      NGRLDAVSNAIKHYFDIDYELAFYEEHSMTKGSSSKAVAYVGVICNK-KRYWGVGIDADI
                        :*****:..:*::        :    * **:: .* *:* :*:.:    .   :* *:. **

ref|ZP_02080303.1|      ITASVKALFSAINR--------------
ref|YP_520543.1|        FTSSVKALISAINTMIKDSA--------
RAAC04058               MEASAKALVSAVNRMLAHRAEMAVPVSK
ref|ZP_01966380.1|      IRASIDALVTAIN---------------
ref|ZP_02073747.1|      IDASVYALISAINR--------------
ref|ZP_02039587.1|      IKASVEALVVAVNKI-------------
                        :  :*   **.  *:*
```

FIG. 86A

```
ref|YP_001125182.1|    ------------------------------------------------------------MNI
ref|YP_147061.1|       ------------------------------------------------------------MNI
ref|ZP_01171540.1|     ------------------------------------------------------------MNI
ref|NP_692464.1|       ------------------------------------------------------------MNI
ref|YP_001375719.1|    ------------------------------------------------------------MNI
RAAC02843              MSRFPVCVFIVSTGQDVVKRAAKFYPDRWHKVGRRHGNVCPVFLCAVSVGGQRRTDIVNI
                                                                                   :**

ref|YP_001125182.1|    HEYQAKEILRSYGVSVPNGRVAFTVDEAVEAAKALGTSVCVVKAQIHAGGRGKAGGVKVA
ref|YP_147061.1|       HEYQAKEILRSYGVSVPNGRVAFTVDEAVEAAKELGAPVCVVKAQIHAGGRGKAGGVKVA
ref|ZP_01171540.1|     HEYQGKEVLRKYGVTVPNGKVAFTVEEAVEAAKELGTEVVVVKAQIHAGGRGKAGGVKVA
ref|NP_692464.1|       HEYQGKQVLREYGVKVPNGYVAYTVDEAVQAAEKLGTSVNVVKAQIHAGGRGKAGGVKVA
ref|YP_001375719.1|    HEYQGKAILRSYGVSVPNGKVAFTVEEAVEAAKELGTDVCVVKAQIHAGGRGKAGGVKVA
RAAC02843              HEYQAKAILAEFGVKVPRGKVAFTVEEAVEAAKELG-GKAVVKAQIHAGGRGKAGGVKVS
                       ****.*  :*  .:**.**.*  **:**:***:**:  **     ******************:

ref|YP_001125182.1|    KSLEEVRTYASELLGKVLVTHQTGPEGKEVKRLLIEEGCDIQKEYYIGLVVDRATSRVVL
ref|YP_147061.1|       KSLEEVRTYASELLGKVLVTHQTGPEGKEVKRLLIEEGCDIQKEYYIGLVVDRATSRVVL
ref|ZP_01171540.1|     KNLDEVRTYASEILGKTLVTHQTGPEGKEVKRLLIEEGCDIQKEYYVGLVLDRATSRVVL
ref|NP_692464.1|       KSLDEVRTYADEILGKTLVTHQTGPEGKEVKRLLIEEGCDIQKEYYVGVVLDRATSRVVM
ref|YP_001375719.1|    KNLEEVRTYAENILGSTLVTHQTGPEGKEVKRLLIEEGCDIKKEYYVGLVLDRATSQVVL
RAAC02843              KSLEEVEANARELLGKRLVTHQTGPQGRIVRRLLIEELTNIQKEYYIGLVLDRSQGRLVM
                       *.*:**.:  *  ::**. ******** *:  :****** :*:*****  :*:****:*:*:**   .::*:

ref|YP_001125182.1|    MGSEEGGTEIEEVAAKTPEKIFKEYVDPAVGLQAFQARRLAFNINIPKKLVNQAVKFMMG
ref|YP_147061.1|       MGSEEGGTEIEEVAAKTPEKIFKEYIDPAVGLQAFQARRLAFNINIPKHLVNQAVKFMMG
ref|ZP_01171540.1|     MASEEGGTEIEEVAEKTPEKIFKEEIDPVIGLTAFQARRIAFNINIPGKLVNQAAKFMLA
ref|NP_692464.1|       MASEEGGTEIEEVAEATPEKIFKEVIDPVVGLTPFQARRLAFNINIPEDLLGKAVKFMSG
ref|YP_001375719.1|    MASEEGGTEIEEVAEKTPEKIFKEYIDPAVGLQGFQARRIAFHINIPKELVGQAVKFMMG
RAAC02843              MASQEGGVEIEEVAAKHPEKIFRETIDPLTGLTPFQANNLAYKLELPQDAVKKAAQFMMA
                       *.*:***.******    *****:*  :**  **  ***...:*::::*   .   :  :*.:**  .

ref|YP_001125182.1|    LYQVFVDKDCSIAEINPLVVTGDGKVMALDAKLNFDSNALYRHPDIMEYRDLDEEDPKEV
ref|YP_147061.1|       LYQVFVDKDCSIAEINPLVVTGDGKVMALDAKLNFDSNALYRHPDILEYRDLDEEDPKEV
ref|ZP_01171540.1|     LYNAYIEKDCSIAEINPLVVTGDGKVMALDAKLNFDSNALYRQKDILEYRDLEEEDPKEI
ref|NP_692464.1|       LYDAFVAKDCSIAEINPLVTTGDGEVLALDAKLNFDDNALYRHKDIQDLRDFEEEDEKEI
ref|YP_001375719.1|    LYRVFIEKDCSIAEINPLVTTGDGKVMALDAKLNFDSNALYRHKDILELRDLDEEDPKEI
RAAC02843              LYNAYVAKDCSIAEINPLVLTAEGDIIALDAKLNFDDNALYRHPEIVSLRDEDEEDPKEI
                       **  .::  ***********  *.:*.::**********.*****: :*  .   **  :*** **:

ref|YP_001125182.1|    EASKYDLNYIALDGNIGCMVNGAGLAMATMDIIKYYGGEPANFLDVGGGASEEKVTEAFK
ref|YP_147061.1|       EASKYDLNYIALDGNIGCMVNGAGLAMATMDIIKYYGGEPANFLDVGGGASEEKVREAFK
ref|ZP_01171540.1|     EASKYDLSYISLDGNIGCMVNGAGLAMATMDIVKHYGGDPANFLDVGGGATAEKVTEAFK
ref|NP_692464.1|       QASKYDLSYVSLDGNIGCMVNGAGLAMSTMDIIKHYGGDPANFLDVGGGATAEKVTEAFK
ref|YP_001375719.1|    EASKYDLNYIPLDGNIGCMVNGAGLAMATMDIIKHYHGDPANFLDVGGGATAEKVTEAFK
RAAC02843              EASKYGLSYIALDGNIGCMVNGAGLAMATMDTIKYYGGEPANFLDVGGGASEEKVTAAFK
                       :****.*.*:.**************.*  ;*:* *:*********:  * *** ref|YP_001125182.1|    IILSDPNVKGIFVNIFGGIMKCDVIASGIVAATKQVGLTLPLVVRLEGTNVELGKKILQE
ref|YP_147061.1|       IILSDPNVKGIFVNIFGGIMKCDVIASGIVAATKQVGLTLPLVVRLEGTNVELGKKILQE
ref|ZP_01171540.1|     IILSDPNVKGIFVNIFGGIMKCDVIAEGVVEAAKQVGLKVPLVVRLEGTNVDLGKKILAE
ref|NP_692464.1|       IILSDKNVKGIFVNIFGGIMKCDVIAEGVVEATKQIGLEIPLVVRLEGTNVDAGKKILDE
ref|YP_001375719.1|    IILSDKNVKGIFVNIFGGIMKCDVIAEGVVEAAKQVGLELPLVVRLEGTNVELGKKILNE
RAAC02843              IILSDPKVKGILVNIFGGIMKCDVIANGVVAAAKQVGLDKPLVVRLEGTNVEAGKKILNE
                       *****  :****:***************.*:*  *:**:**      ************: ***** *
```

```
FIG. 86B
ref|YP_001125182.1|     SGLNITAAESMADGAQKIVELV
ref|YP_147061.1|        SGLNIIAAESMADGAQKIVELV
ref|ZP_01171540.1|      SDIDIIAADSMSDGAEKIVSLV
ref|NP_692464.1|        SGLNITTATSMADGAEKIVAAV
ref|YP_001375719.1|     SGLNIVAAESMADGAQKIVSLV
RAAC02843               SGLKLVAADSLADAAQKIVALV
                        *.:.:  :*  *::*.*:***   *
```

FIG. 87

```
ref|YP_147062.1|        MSVFVNKDTKVIVQGITGSQGLFHTKQMIEYGTNIVGGVTPGKGGTEVEGVPVFDTVSEA
ref|YP_001125183.1|     MSVFVNKDTKVIVQGITGSQGLFHTKQMIEYGTNIVGGVTPGKGGTEVEGVPVFDTVSEA
ref|NP_243335.1|        MSILINKDTKVIVQGITGATGLFHTKQAVEYGTNIVGGVTPGKGGTEVEGIPVFDTVSQA
ref|YP_079003.1|        MSVFINKDTKVIVQGITGSTALFHTKQMLEYGTKIVGGVTPGKGGTEVEGVPVFNTVEEA
ref|ZP_01171539.1|      MSVFINKDTKVIVQGITGSTALFHTKQMLEYGTQIVGGTTPGKGGMEVEGVPVFNTVQEA
RAAC02844               MSILVNKETRVITQGITGSAGLFHTQQALAYGTKVVGGTSPGKGGTKVEGLPVFNTVEEA
                        ::.:*:.*:  .**:*  :  *::*.:***  :*:*:..:* ref|YP_147062.1|        VERTGANASVIYVPPAFAADAIMEAVDAGLDLVVCITEGIPVLDMVKVKRYMEGKKTRLI
ref|YP_001125183.1|     VEKTGANASVIYVPPAFAADAIMEAVDAELDLVVCITEGIPVLDMVKVKRYMEGKKTRLI
ref|NP_243335.1|        VEATGANASVIYVPPAFAADAIMEAVDAELDLAICITEGIPVMDMVKVKRYMEGKKTRLV
ref|YP_079003.1|        VKQTGANASVIYVPAAFAADAIMEATDAELDLVICITEHIPVLDMVKVKRYMEGKKTRLI
ref|ZP_01171539.1|      VKETGATASVIYVPAAFAADAILEAVDAELDLAICITEHIPVLDMVKVKRYMEGKKTRLV
RAAC02844               VRETGANASVIYVPPAFAADAIMEAVAAGIELVVCITEGIPILDMVKVKRYMEGKKTRLI
                        *. ***.*******.*******:**.  * ::*.:**** **::****************:

ref|YP_147062.1|        GPNCPGVITPEECKIGIMPGYIHKKGHVGIVSRSGTLTYEAVHQLTQAGIGQSTAVGIGG
ref|YP_001125183.1|     GPNCPGVITPEECKIGIMPGYIHKKGHVGIVSRSGTLTYEAVHQLTQAGIGQSTAVGIGG
ref|NP_243335.1|        GPNCPGVITPEECKIGIMPGYIHKKGHVGVVSRSGTLTYEAVHQLSTAGIGQSTAVGIGG
ref|YP_079003.1|        GPNCPGVITPEECKIGIMPGYIHKKGHVGVVSRSGTLTYEAVHQLSEAGVGQSTAVGIGG
ref|ZP_01171539.1|      GPNCPGVITPDECKIGIMPGYIHTKGHVGVVSRSGTLTYEAVHQLTQAGIGQSTAVGIGG
RAAC02844               GPNCPGVITPNECKIGIMPGYIHTPGKIGVVSRSGTLTYEAVYQLTQLGLGQSTAVGIGG
                        ********:*******. *:*:.**************::  :*********** ref|YP_147062.1|        DPVNGTNFIDVLKAFNEDEETYAVIMIGEIGGTAEEEAAEWVKANMTKPVVGFIGGQTAP
ref|YP_001125183.1|     DPVNGTNFIDVLKAFNEDDETYAVIMIGEIGGTAEEEAAEWVKANMTKPVVGFIGGQTAP
ref|NP_243335.1|        DPVNGTNFIDVLKLFNEDPDTYAVIMIGEIGGTAEEEAAEWIKANMTKPVVGFIGGQTAP
ref|YP_079003.1|        DPVNGTNFIDVLKAFNEDPDTHAVIMIGEIGGTAEEEAAEWVKANMTKPVVGFIGGKTAP
ref|ZP_01171539.1|      DPVNGTNFIDVLKAFNEDPETKAVIMIGEIGGTAEEEAAEWVKANMTKPVVGFIGGRTAP
RAAC02844               DPVNGTNFVDVLKMFNDDPDTEAVIMIGEIGGSAEEEAAEWIKANMKKPVVGFIAGATAP
                        ******: :*  :*  ********:***:.****** * *** ref|YP_147062.1|        PGKRMGHAGAIISGGKGTAAEKIKKMTECGIKVAETPAVIGETLISVLKERGLYEKCKT
ref|YP_001125183.1|     PGKRMGHAGAIISGGKGTAAEKIKKMNECGIKVAETPAVIGETLISVLKERGLYEKCKT
ref|NP_243335.1|        PGKRMGHAGAIISGGKGTAAEKIKTLESCGVKVAETPSVMGETLISVLKEQGLLEKC--
ref|YP_079003.1|        PGKRMGHAGAIISGGKGTADEKIKTMNACGIEVAETPSVMGETLIKVLKEKGLYETCKT
ref|ZP_01171539.1|      PGKRMGHAGAIISGGKGTADEKIRVMNECGIQVADTPSVMGETLIKVLKEKGLFDECKT
RAAC02844               PGRRMGHAGAIVSGGSGTAQSKIEKMKACGIRVAPTPSEMGSTLYQVLEERGLLERCKS
                        **:*********:***.***  .**.  :  **:.**  **:.**  .**:*:**  : *
```

FIG. 88

```
ref|YP_001127392.1|        --------------------------RKFAWGPLMGVMKQREEHIANEIDQAEKRRQEA
ref|YP_149215.1|           --------------------------RKFAWQPLMNIMKQREEHIANEIDQAEKRRQEA
ref|YP_001488543.1|        --------------------------KKFALKPLLGIMKQREDYIGNEISSAEQKHVQA
ref|YP_093437.1|           -------FNAGTMLFQLVAMLILLALLKKYALGPLLNIMKEREDYITGEISSAEKKNEEA
ref|YP_521149.1|           --------------------------RRFAWNPLINMMEERRSQIEANIANAEKERLQA
RAAC00454                  MFQVGGIFQVGTFIFSVISFLIVFFIIQRFAFKPLARMLEQRRIHIETQISEAEKSREEA
                                                     :::*  **  ::::*.  *  :* .**: . :* ref|YP_001127392.1|        EKLLEEQRELLKQSRQEAQTILENARKLAEEQKEQIVASARAEAERVKEAAKQEIEREKE
ref|YP_149215.1|           EKLLEEQRELMKQSRQEAQALIENARKLAEEQKEQIVASARAEAERVKEVAKKEIEREKE
ref|YP_001488543.1|        EKLLEEQRVLLKEAREESHTLIENAKKIGEKQKEEIIQAARQESERLKDSARTEIVKEKE
ref|YP_093437.1|           KKLIEEQQALLKEAREESQSLIENAKKLGEQQKDEIIKAARQEAERMKESARSEIVKERD
ref|YP_521149.1|           EQIKREYQEEMRKARQEAQEVIAKATKLSEQRAAEILAAHGEAEKIKQSALADIERERD
RAAC00454                  ERLLAEQQRLLEEARKEARNLLDQARIRADEQAREIVQKAEEEAARILEESRQAIVRERD
                            :::  * :  :.::*:*:::  :: :*   .:::  :*:  *. *: :: :    * :*::

ref|YP_001127392.1|        QAMAALREQVASLSVLIASKVIERELTEQDQRKLI------------
ref|YP_149215.1|           QAMAALREQVASLSVLIASKVIEKELTEQDQRKLI-----------
ref|YP_001488543.1|        QAVAALREQVASLSVLIASKVIERELDEQAQEKLIQEYLKEAGE---
ref|YP_093437.1|           QAVTALREQVASLSVMIASKVIEKELDEQAQEKLIQDYLKEVGE---
ref|YP_521149.1|           RAIAQVQAQVADLSVAVAEKIIRKNLDVRGQEDMIEQFIQEVGELPC
RAAC00454                  EALAAVTKRVAELSVELTTKLLRDHVTAELHKELVAEAESKLGELVC
                           .*:: :   :**.*** :: *::. .:  . :...::
```

FIG. 89

```
ref|YP_001421255.1|    --MNVGNISTAMITPFDSKGNVDFQKLSTLIDYLLKNGTDSLVVAGTTGESPTLSTEEKI
ref|NP_389559.1|       --MNFGNVSTAMITPFDNKGNVDFQKLSTLIDYLLKNGTDSLVVAGTTGESPTLSTEEKI
ref|YP_091490.1|       --MNFGNIATAMVTPFDKNENIDFQKLSKLIDYLLNNGTDSLVVAGTTGESPTLSEEEKV
ref|YP_001125250.1|    ----FGNIVTAMVTPFDRKGNLDLAKTTELVNYLLDNGTDALVVAGTTGESPTLTAEEKV
ref|ZP_02169638.1|     --MSFGTVLTAMVTPFDDQGMINYDQLEVLINHLIENGSDGLVVGGTTGESATLSIEEKA
RAAC02920              MRMDFGSLITAMVTPFDATGALDEGRLRRLVDHLIETGTTAVVVCGTTGESPTLSHAEKL
                         .*.: ***:****     ::   :  *:::*:..*: .:** ******.**:  **

ref|YP_001421255.1|    ALFEFTVKEVNGRVPVIAGTGSNNTKDSIKLTKKAEEAGVDCVMLVTPYYNKPSQEGMYR
ref|NP_389559.1|       ALFEYTVKEVNGRVPVIAGTGSNNTKDSIKLTKKAEEAGVDAVMLVTPYYNKPSQEGMYQ
ref|YP_091490.1|       ALIQYSVKEAAGRAPIIAGTGSNNTKASIKLTKKAEEAGADAVMLVTPYYNKPSQEGMYR
ref|YP_001125250.1|    ALFRHVVNVVNGRVPVIAGTGTNDTRASIELTKRAEETGVDAVMLVAPYYNKPNQEGLYQ
ref|ZP_02169638.1|     ALYQQSVRIADGRVPIIAGTGMNDTYATAELTIRAERVGVDGIMLVAPYYNKPSQKGLYE
RAAC02920              RLFDATLRAVDGRIPVIAGTGTNSTKDSIELTLEAARLGVQAVMLVTPYYNRPSQEGLYM
                        *   :. . ** *:***** *.*  : :** .* . *.: :*:**:*.*:*:* ref|YP_001421255.1|    HFKAIAEETSLPVMLYNVPGRTVASLAPETAIRLA-EIPNISAIKEASGDLDAITKIIAE
ref|NP_389559.1|       HFKAIAAETSLPVMLYNVPGRTVASLAPETTIRLAADIPNVVAIKEASGDLEAITKIIAE
ref|YP_091490.1|       HFRAIAEETSLPVMLYNVPGRTAASLAPETTIRLA-EIPNIIAIKEASGDLDAITKIVAE
ref|YP_001125250.1|    HFKAIAESTSLPVMLYNVPGRTSVNLAPETVIRLA-AIPNIVAVKEAGGNLDAMAEIIEQ
ref|ZP_02169638.1|     HFQTIAEKTSLPVMVYNVPGRTAVNILPETVIELA-KIENITSVKEASGNLDQVTMIVAN
RAAC02920              HFASIAESTTLPVMLYNVPGRTGVNLQPQTALQLA-AIPNVVALKEASGDFSQILRIAAE
                       **  :**  .*:****:******  .: *:*..:.**   * *: ::***.*::.  :  *   :

ref|YP_001421255.1|    TPEDFYVYSGDDGLTLPILAVGGRGVVSVASHIVGSDMQQMIKNYTNGQTATAALIHQKL
ref|NP_389559.1|       TPEDFYVYSGDDALTLPILSVGGRGVVSVASHIAGTDMQQMIKNYTNGQTANAALIHQKL
ref|YP_091490.1|       TPEDFAVYSGDDSLTLPALSVGARGIVSVASHIIGPEMQEMIKHYTEGNTAQAALIHQKL
ref|YP_001125250.1|    TPDDFLLYSGDDSTLPVLAIGGAGVVSVASHIIGNEMQQMIRAFQAGDHQKAAALHRKW
ref|ZP_02169638.1|     TPDDFTVYSGDDSLTLPSLAVGADGIVSVSSHIIGKHMQQMVRYYKDGQVGEAALLHQKL
RAAC02920              KPDDFLLYSGDDKFTLPMLAIGAAGVVSVAGHVVGRQIRTMMDLFWQGQVDEAAYWSARL
                        .*:** :*****  :*** :****  *:***:.*: *  *: :   *:         ** **    :

ref|YP_001421255.1|    LPIMKELFKAPNPAPVKTALQLKGLDVGSVRLPLIPLNEDERLSLSSVISEL-------
ref|NP_389559.1|       LPIMKELFKAPNPAPVKTALQLRGLDVGSVRLPLVPLTEDERLSLSSTISEL-------
ref|YP_091490.1|       LPLMKGLFAAPNPSPLKTALQLKGLDVGPVRLPLIPLNEDERLRLSSLMNGL-------
ref|YP_001125250.1|    VPLMKGLFAAPSPVPVKTALQLRGLDVGPVRLPLVPLTEQERSELSRLLSAL-------
ref|ZP_02169638.1|     LPIMRGMFIAPSPAPVKTALDMTGLDVGGVRLPLVPLTEEERKTLESIV---------
RAAC02920              LPIFEAMFMEASPAPVKEALSILGIDVGSVRSPLVPASKALREHLYTLLNALGVIEPSA
                       :*::. :*   ..* *:* **.: *:*** ** **:* .:     *    *     :
```

FIG. 90A

```
ref|NP_844736.1|        ------------------------------------------------IKRVKNHIN
ref|NP_832053.1|        ------------------------------------------------IKRVKNHIN
ref|YP_001375026.1|     ------------------------------------------------IKRVKNHIN
ref|NP_691737.1|        ------------------------------------------------KHMQNYIN
ref|YP_175305.1|        ------------------------------------------------VKTVKNWID
RAAC02924               ------------------------------------------------MRRLQNYVN
                                                                        : ::* ::

ref|NP_844736.1|        GEWVESTGTEVEAVPNPATGKIIAYVPLSPKEDVEKAVEAAKAAYETWSKVPVPNRSRQL
ref|NP_832053.1|        GEWVESTGTEVEAVPNPATGKIIAYVPLSPKEDVEKAVEAAKAAFETWSKVPVPNRSRNL
ref|YP_001375026.1|     GEWVESTGTEVEAVPNPATGKIIAYVPLSPKEDVERAVEAAKNAYETWSKVPVPNRSRML
ref|NP_691737.1|        GKWVDAKSGKQEVIPNPATGETIATVTISDVEDVDMAVAAAKEVFPEWSDIPVPNRTRYL
ref|YP_175305.1|        GAWVEASTADTEVVPNPATGEAIAYVPLSGERDVEQAVASAKRAYETWKTVPVPERTRYM
RAAC02924               GTWVEVESEHAVPVYNPATGEVIAETPLSTHVDVARAVEGAKRAFASWSRVPVVKRARVV
                         * **:        .   : *****: **  ..:*   **  ** .**  .:  *.   :**  :*:* :

ref|NP_844736.1|        YKYLQLLQENKEELAKIITLENGKTLTDATGEVQRGIEAVELATSAPNLMMGQALPNIAS
ref|NP_832053.1|        YKYLQLLQENKDELAKIITLENGKTLTDATGEVQRGIEAVELATSTPNLMMGQALPNIAS
ref|YP_001375026.1|     YKYLQLLQENKDELSKIITLENGKTLKDASGEVQRGIEAVELATSAPNLMMGQALPNIAG
ref|NP_691737.1|        LDYWKLLQDNKEELAKIITLENGKSLRDAQGEVQRGIEVVELATSTPSMMMGDALPSIAK
ref|YP_175305.1|        FAYLEQLKKNREQLAQLITLENGKTIKDARGEVQRGIECVELATSTPTMMMGDALPDIAS
RAAC02924               FDFLAKLKAERDAIAKMITTEHGKSYLDAQAEVDRGIEGIEHALSAPTLMMGESLAEVSE
                          :   *:  ::: ::::** *:**:   **  .**:****  :*  *  *:*.:***::*..::

ref|NP_844736.1|        GIDGSIWRYPIGVVAGITPFNFPMMIPLWMFPLAIACGNTFVLKTSERTPLLAERLVELF
ref|NP_832053.1|        GIDGSIWRYPIGVVAGITPFNFPMMIPLWMFPLAIACGNTFVLKTSERTPLLAERLVELF
ref|YP_001375026.1|     GIDGSIWRYPLGVVAGITPFNFPMMIPLWMFPLAIACGNTFVLKTSERTPLLAERLVELF
ref|NP_691737.1|        GIDGSIWRYPLGVVAGITPFNFPMMVPLWMFPLAIACGNTFVLKTSERTPILAERLVELF
ref|YP_175305.1|        GIDGSIWRYPLGVVAGITPFNFPMMVPLWMFPLAIAAGNTFVLKTSERTPLLAEQLVSLM
RAAC02924               GLEQTYYRYPLGVVASITPFNFPAMIPLWVMGWAVVTGNALILKPSEQTPMTTLRLVEMF
                        *::  : :***:****.******  *:***::    *:. **:::**.**:**:  : :**.::

ref|NP_844736.1|        YEAGFPKGVLNLVQGGKDVVNSILENKDIQAVSFVGSEPVARYVYETGTKHGKRVQALAG
ref|NP_832053.1|        YEAGFPKGVLNLVQGGKDVVNSILENKDIQAVSFVGSEPVARYVYETGTKHGKRVQALAG
ref|YP_001375026.1|     YEAGFPKGVLNLVQGGKEVVNSILENKEIQAVSFVGSEPVARYVYETGTKYGKRVQALAG
ref|NP_691737.1|        YEAGFPKGVLNLVHGGKEVVNRFLTHPDIEAVSFVGSEPVAKHVYQTGTAHGKRVQALAG
ref|YP_175305.1|        HEVGLPRGVLNLVNGGKAVVNGLLNHPDVEAISFVGSEPVARYVYETGTANGKRVQALAG
RAAC02924               HEAGLPPGVLQAVNGGKEAVDAILSHPEIVAVNFTGSTRTAAYVYETAARHHKRVQAFAG
                        :*.*:* ***: *:***  .*:  :*  :  *::*.*.**   *  :**:*.:       ***** :**

ref|NP_844736.1|        AKNHAIVMPDCNLEKTVQGVIGSAFASSGERCMACSVVAVVDEIADEFIDVLVAETKKLK
ref|NP_832053.1|        AKNHAIVMPDCNLEKTVQGVIGSAFASSGERCMACSVVAVVDEIADEFIDVLVAETKKLK
ref|YP_001375026.1|     AKNHAIVMPDCNLEKTVQGVIGSAFGSSGERCMACSVVAVLDEIADEFIDALVSETRKLK
ref|NP_691737.1|        AKNHAVVMPDCDVEKTIQGVLGAAFGSSGERCMACSVVAVVDDIADEFLEKLVKETKKLR
ref|YP_175305.1|        AKNHAVVLADCELDKTVQGVIGAAFASSGERCMACSVVAVVEEVADAFIEKLTAETKKLT
RAAC02924               AKNHAIVLEDAVLEPTIDGILRAAFHNGGQRCMATSVVAVGSVADEVVERLAEGARRMK
                        *****:*: *.     :: *::*:: :**   . .:****    ***...:  .:** .:  *.    ::::

ref|NP_844736.1|        VGDGFHEDNYVGPLIRESHKERVLGYINSGVADGATLLVDGRKIKEEVGEGYFVGATIFD
ref|NP_832053.1|        VGDGFNEDNYVGPLIRESHKERVLGYINSGVADGATLLVDGRKINEEVGEGYFVGATIFD
ref|YP_001375026.1|     VGDGFHEENYVGPLIRESHKERVIGYINSGVADGASLLVDGRQIKEDVEGGYFVGATIFD
ref|NP_691737.1|        VGDGMDDSNFIGPVIRESHKERVLSYIDSGVDEGAHLLVDGRKIKEETPDGYYVGATIFD
ref|YP_175305.1|        VGNGKNDEHFVGPLIRQSHKDKVVKYIEQGVEQGAELLVDGRNATSEE-AGYYLGATLFD
RAAC02924               IGHGFEEGVDVTPLIRKEHRDRVRAYVDEAAMS-ARLVVDGRPAIDEHPEGFYLGPCLLD
                        :*.* .:    : *:**:.*:::*  *:::.*  *:..  .   *:****   .: *:::*. :::*
```

FIG. 90B

```
ref|NP_844736.1|      GVNQEMKIWQDEIFAPVLSIVRVKDLEEGIKLTNQSKFANGAVIYTSNGKHAQTFRDNID
ref|NP_832053.1|      GVNQEMKIWQDEIFAPVLSIVRVKDLEEGIKLTNQSKFANGAVIYTSNGKHAQTFRDNID
ref|YP_001375026.1|   GVNQNMKIWQDEIFAPVLSIVRVRDLEEGIQLTNQSKFANGAVIYTSSGKHAQTFRDHID
ref|NP_691737.1|      HVTQDMKIWQDEIFAPVLSVVRVSDLEEGIRVTNQSKFANGAVIYTNSGKSAQQFRNRID
ref|YP_175305.1|      HVTPEMTIWQEELFAPVLSIVRVRDLEEAIALTNRSRFANGAVIYTSSGKAAQHFRNAID
RAAC02924             GVTPEMRVWQEELFGPVLSVVRARDLDEAIAIANRSRYANGAILYTQSGKAAQVFRDRID
                       *.  :* :**:*:*.****:**. **:*.* ::*:*::****:**..** ** **: **

ref|NP_844736.1|      AGMIGVNVNVPAPMAFFAFAGNKASFFGDLGTNGTDGVQFYTRKKVVTERWF
ref|NP_832053.1|      AGMIGVNVNVPAPMAFFAFAGNKASFFGDLSTNGTDGVQFYTRKKVVTERWF
ref|YP_001375026.1|   AGMIGVNVNVPAPMAFFAFAGNKASFYGDLGTNGKDGVQFYTRKKVVTERWF
ref|NP_691737.1|      AGMIGVNVNVPAPMAFFSFAGNKASFYGDLGTNGKDGVQFYTRKKVVTERWF
ref|YP_175305.1|      AGMVGINVNVPAPMAFFSFAGNKASFFGDLGTNGRDGIQFYTRKKVVTERWF
RAAC02924             AGMVGINVNVPLPVAFFPFGGHKDSFYGVTGENGKELVQFFTRRKVVSTRWF
                      ***:*:***** *:***.*.*:* . ** : :**:**:***: ***
```

FIG. 91A

```
ref|YP_148646.1|         ----------DLIAPERYNLTSEMERHAAADPDRIALKWESEQGETKEITYGRLMARANQ
ref|ZP_01859600.1|       ----------DLLSPERYNLISEVEKFAGEQ-GKKAIIWKSEQGEEKEITYENLIKNANK
ref|YP_001376529.1|      ----------ELLAPPSYNLVTEIEKYMNEK-DKLALIWQDEKGARREVTYFELIKGANK
ref|YP_038694.1|         ----------ELLAPPSYNLVSEIEKYTGDK-EKLALIWQDDKGNRREVTYAELMKGANK
ref|ZP_01696063.1|       ---------SDLIAPQTYNIAEEIEKYARDP-HKVALIWEDKEGMHREVTYKELIENANR
RAAC02926                MEPSQTAAFAELLAPDVFNIASAILDRDESR---RALVWRSEAGAKRTLTYGELRRESLR
                                   :*::*  :*:   :          *: *... *  : :** .*   : :

ref|YP_148646.1|         IGNAFLSHGLEKGDKVLVMMPRLIETYEVYIGALKAGLVVIPSSEMLRTKDLQYRLVHSE
ref|ZP_01859600.1|       IGNAFINNGLEKGDVVLVMIPRLIEAYETYVAALKAGMVVIPSSEMLRAKDLKYRIEHGD
ref|YP_001376529.1|      IGNAFIKSGLQKGDKLLIMMPRLIEAYMTYIGAIKAGFVVIPSSEMLRKKDIEYRIQHGE
ref|YP_038694.1|         IGNAFIKSGLQKGDKLLIMMPRLIEAYMTYIAAIKAGFVVIPSSEMLRKKDIEYRIGHGE
ref|ZP_01696063.1|       TGHVFLESGLKKGDTILVMVPRIVEAYEVYLAAMKCGIVLLPASEMLRTKDLDYRIEAGD
RAAC02926                LAQSLHDLGLRKGDRVLVLMPRRPETYAVYLAILSLGAVVLPGSELLMPNDIAYRLRHAE
                          .:  : . **.*** :*:::**   *:* .*:. :. * *::*.**:*  :*: **:   .:

ref|YP_148646.1|         AKAVVAYAPYTDEFAPIDGIERLTKF--VIGEP-RDGWIPLEDAMAKESETLEAADTSRD
ref|ZP_01859600.1|       VKAVVCYEPYTEQFDELEESSGL--MKFVVGAE-KEGWLSLDSLKNESSDELALADTGRE
ref|YP_001376529.1|      VKAIISYEPYISQFEGIEGMDS--LQKFVLSEKEVDGWANLNTALETESDVLDIVKTDKE
ref|YP_038694.1|         VKAIVSYEPYIGQFDDIEAMES--LQKFVLSEQSVDGWINLKTALETESDMLEMAKTDKE
ref|ZP_01696063.1|       VKGVVAHYSCTEQFKEVRGIDHLKKF--VIGEP-EQGWAFLDEKKKAAPCELEIAKTSKD
RAAC02926                AKGVIAHAALAERAEAAIAEAPWVQLRVVVEGP-REGWLAYDDLVRGAPREWDVVPTRRD
                          .*.::.:  .             .            *:        :**   .     . * ::

ref|YP_148646.1|         DMAFLSYTSGTTGNPKGVVHCHGWAYAHLRTAAKNWLCIEEGDLVWATAGPGWQKWIWSP
ref|ZP_01859600.1|       DMAFLSYTSGTTGNPKGVVHTHGWAYAHLRTAAKKWLSIEEGDTVWATAGPGWQKWIWSP
ref|YP_001376529.1|      DMVFLSYTSGTTGNPKGVVHTHAWGYAHLRTSAPNWLGIEENDIVWATASPGWQKWIWSP
ref|YP_038694.1|         DMVFLSYTSGTTGNPKGVVHTHAWAYAHLRTSAPNWLGIEENDVVWATASPGWQKWIWSP
ref|ZP_01696063.1|       DIAILSYTSGTTGNPKGVIHTHSWGYAHLRTAAPNWLGIQKGDRVWATAAPGWQKWVWSP
RAAC02926                DLAFLSYTSGTTGYPKGVMHVHGWAYAHWHIAAKRWLGIEPDDVVWATAGPGWAKWIWSP
                         *::.:******* **:* *.*.***   :*  .** *:  .*  *** .* :* ref|YP_148646.1|         FLSVLGSGATGFVYYGRFEPETYLQLLEKYNINVLCCTPTEYRLMAKVPDIGRYHLSHLH
ref|ZP_01859600.1|       FLSVLGSGATGLVYQGKFEPDTYLQMLEDYQVNVLCCTPTEYRLMAKVDDLGKYHLQHLH
ref|YP_001376529.1|      FLATLGSGATGFVYHGKFEPKTYLQLLDENQVNVLCCTPTEYRLMAKVENLQQYNLKALH
ref|YP_038694.1|         FLATLGSGATGFVYHGKFEPKTYLNLLDDNKVNVLCCTPTEYRLMAKVENLSEYNLEALH
ref|ZP_01696063.1|       FLSVLGSGAIGFVYNGRFDPEKYLSLLDEYEINVLCCTPTEYRLMAKVDDLSQYHLKSLR
RAAC02926                FVATLMSGATGFHYGGRFDAETFLRLIDDEAVNVLCATPTEYRMMAKVDGLDRFRLSSLR
                         *::.* ***  *: *  *:*...:*  :::.  :****.******:****   .: ..:.*. *:

ref|YP_148646.1|         SAVSAGEPLNREVIDTFAKHFGVEVRDGYGQTENTLLVGVMKGMPIKPGSMGKPTPGNRV
ref|ZP_01859600.1|       SAVSAGEPLNREVIDAFQKHFNVDVRDGYGQTENTLLVGIMKGMELKPGSMGKPTPGNRV
ref|YP_001376529.1|      SAVSAGEPLNREVIETFQKHFQVTVRDGYGQTENTLLIGVMKGMEIRPGSMGKPTPGNQV
ref|YP_038694.1|         SAVSAGEPLNREVIETFQKHFHITVRDGYGQTENTLLVGVMKGMDIRPGSMGKPTPGNHV
ref|ZP_01696063.1|       SAVSAGEPLNREVIDVFQNHFGITIRDGYGQTESTLLVGYSLDTPLRPGSMGKPFPGNEV
RAAC02926                QAVSAGEPLNREVIDTFRRHFQVTVRDGYGQTENTLLVATCVDTEVRPGSMGLPTVEGAV
                          .************:.* .  :  *****.*:.    .  ::***** *   . * ref|YP_148646.1|         EIIDENGEPCPPGQVGDIAVHIETPALFKYYYKDPERTAMQFRGDYYITGDKARKDEDGY
ref|ZP_01859600.1|       EIIDEDGKPCSPGEVGDIAVHVDTPALFKNYYKDPERTAMQFRGDYYITGDKAKKDEDGY
ref|YP_001376529.1|      EIINEEGHPVSVGEVGDIAVHIDTPALFKQYYKDDERTAMQFRGDYYITGDKAKKDEDGY
ref|YP_038694.1|         DIVDEEGMPVRVGEVGDIAVHIETPALFKQYYKDDERTAMQFRGDYYITGDKAKKDEDGY
ref|ZP_01696063.1|       EIVNDDGKPCKLGETGDIAVHRDTPALFKGYYKEPERTAKQYRGDYFITGDRARKDEDGY
RAAC02926                DIVDDEGRPLPPGQVGDIAVRRDFPALFRGYYKDDERTEAQFRGAWYITGDRAEKDEDGY
                         :*::::* *  *:.****:  : ****: ***. ***   *:**  ::****:*.******
```

FIG. 91B

```
ref|YP_148646.1|         FWFEGRGDDIIISAGYTIGPFEVEDALVKHPAVKECAVVASPDEVRGHVVKAFVVLRD--
ref|ZP_01859600.1|       FWFEGRGDDIIISSGYTIGPFEVEDALVKHPSVKECAVVASPDEVRGNIVKAFVVLRD--
ref|YP_001376529.1|      FWFEGRGDDIIISSGYTIGPFEVEDALVKHPYVRECAVVASPDEIRGSVVKAFIVLRD--
ref|YP_038694.1|         FWFEGRGDDIIISSGYTIGPFEVEDALVKHPYVRECAVVASPDEIRGSVVKAFIVLRE--
ref|ZP_01696063.1|       FWFEGRRDDIIISSGYTIGPFEVEDALVKHPYVKECAVVASPHEIRGSIVKAFVVLKD--
RAAC02926                LWFSGRADDIIISAGYTIGPFEVEDALVKHPLVRECAAVSSPDEVRGAIVKAFVVLKDAN
                         :**.** ******:**************** *:***.*:**.*:** :****:**::

ref|YP_148646.1|         ------GVDKDD--------PSLIPALQEHVKQLTAPYKYPRKIEFVDDLPKTASGKIRR
ref|ZP_01859600.1|       ------GVSPED--------PDLVKSLQDHVKELTAPYKYPRKIEFIEELPKTTSGKIRR
ref|YP_001376529.1|      ------NVQE----------KEDTLIPLLQEHVKTLTAPYKYPRKIEFVDELPKTISGKIRR
ref|YP_038694.1|         ------NIEK----------NEETLIPILQQHVKELTAPYKYPRKIEFVDELPKTISGKIRR
ref|ZP_01696063.1|       ------GISEN---------LPGLVKELQNHVKQLTAPYKYPRAIEFIKELPKTASGKIRR
RAAC02926                ---LHRELASDGE-----RREALVRELQEHVKRITAPYKYPRAIEFVEDLPKTTSGKIRR
                              :           *:  :* :****** *:.:** **** ref|YP_148646.1|         VELRERE-------------
ref|ZP_01859600.1|       IELRQNERKTVQK-------
ref|YP_001376529.1|      VELRKQEMELRLK-------
ref|YP_038694.1|         IELRKQE-------------
ref|ZP_01696063.1|       VELRQQEWNR----------
RAAC02926                VELREREWKRHRKLNEEQGG
                         :***:.*
```

FIG. 92A

```
ref|YP_146227.1|        ----------NYINGEWKEPSTGQFAPVINPATGETIAEVAMSGPNDIDEAVQAAKEAQ
dbj|BAB39706.1|         ------------------------------------------SGPNDIDEAVQAAKEAQ
ref|YP_001124476.1|     ----------LNFINGKWQPALSGQWAPVINPANGETIGEVALSAAADVDAAVKAAKAAQ
ref|ZP_01695767.1|      -------EKYLNYIDGEWCEPSTGKFAPVVNPANGKTLGEVAQSAEPDLDRAVQAAKSAQ
RAAC02986               MRRMHRFEPCLNFIGGRWREPKTGQYGDNVNPANGEVLGVWARSGPDDLDDAVRAAREAQ
ref|ZP_01723231.1|      ----------NYIGGKWSTHSHLQSIAVTNPANGEQLATIPLSTSNEVDEAVVAAKQAQ
                                                      *  ::* ** **: **

ref|YP_146227.1|        KQWALVPAPKRAEILYKVGMLLKERKEQLARMLTMEMGKVIEEARGEVQEGIDMAFYMAG
dbj|BAB39706.1|         RQWALVPAPKRAEILYKVGMLLKERKEQLARLLTMEMGKVIEEARGEVQEGIDMAFYMAG
ref|YP_001124476.1|     KKWALVPAPKRADVLYKVGLLLKERKEQLARLLTMEMGKVIEEARGEVQEGIDMAFYMAG
ref|ZP_01695767.1|      SVWRLVPAPERANYLYKVGELLKQRKEQIARTLTSEMGKVIDEARGEVQEAIDMAFYMAG
RAAC02986               AAWRLVPAPERAKVLRRVADLLRDRKDEIARTLTMEMGKVIEEARGEVQEAIDMAEYMAG
ref|ZP_01723231.1|      KSWALVPAPKRAEFLYAIGQKMKEKKEYLATVLTKEMGKVIEEARGEVQEGIDMAYYMAG
                         * *****:**. *  :.   ::::*: :*  ** ******:******. **** ****

ref|YP_146227.1|        EGRRLFGDTTPSELKDKFAMSVRVPVGVVGIITPWNFPIAIATWKSFPAIVAGNAVVWKP
dbj|BAB39706.1|         EGRRLFGDTTPSELKDKFAMSVRTPVGVVGIITPWNFPIAIATWKSFPAIVAGNAVVWKP
ref|YP_001124476.1|     EGRRLFGDTTPSELKDKFAMSVRVPVGVVGIITPWNFPIAIATWKSFPAIVAGNAVVWKP
ref|ZP_01695767.1|      EGRRQFGDTVPSELQNKFAMSIRVPVGIAGLITPWNFPIAIASWKSLPALVTGNAVIWKP
RAAC02986               EGRRLFGQTTPSELPDKFAMSVRVPVGVVGIITPWNFPIAIASWKSLPAIVAGNAVVWKP
ref|ZP_01723231.1|      EGRRLFGETTPSELANKFAMSVRAPIGVVALITPWNFPVAIATWKSFPAIVAGNTFIWKP
                        **** **:*.****  :****:*.*:*:..;:*********:***.***:**:.;:**

ref|YP_146227.1|        APETPIMAQELARIFEEAGLPPGVFHVVHGDGPTVGNALVEHPDVKVISFTGSNEVGRMI
dbj|BAB39706.1|         APETPIMAQELARIFEEAGLPPGVFHVVHGDGPTVGNALVEHPDVKVISFTGSNEVGRMI
ref|YP_001124476.1|     ALETPFMARELAAIFTEAGLPDGVFNVVHGDGPTAGNALVEHPDVPVISFTGSNEVGRQI
ref|ZP_01695767.1|      ATETPATACAFVKIYEEAGLPKGLVNLVHGSGSVIGEAMVEHPGIGLISFTGSNEVGRKI
RAAC02986               AEETPLTARAFVEVYQEAGLPAGVLNVVFGDGPVVGEAMLHHPGIDVISFTGSTETGRHI
ref|ZP_01723231.1|      SNETPMMACEMGKIFEEVGLPDGVANIVFGTGPTVGTALIEHPDVKVISFTGSTTTGSKV
                        : ***   *   :  :: *.*** *:  ::*.*  *..  * *:;.**.; :******. .*   :

ref|YP_146227.1|        AEKCGRLLKKVSLEMGGKNAVIVMDDADLTLAVDGIIWSAFGTSGQRCTACSRVIVHERV
dbj|BAB39706.1|         AEKCGRLLKKVSLEMGGKNAVIVMDDADLTLAVDGIIWSAFGTSGQRCTACSRVIVHERV
ref|YP_001124476.1|     AEKCGRLLKKVSLEMGGKNAVIVMDDADLTLAVDGIVWSAFGTSGQRCTACSRVIVHERV
ref|ZP_01695767.1|      NERAGGLLKRTSLEMGGKNAVIVMDDADLDLAVDGILWGAFGTSGQRCTATSRVIVHKKI
RAAC02986               ASRAGANLKRVSLEMGGKNAITVLADADLDLAVDAILWSAYGTSGQRCTAASRVIVEREA
ref|ZP_01723231.1|      AELGGKHLKKISLEMGGKNAVIVMDDADLQLATEGILWSAFGTAGQRCTACSRVIVHKDV
                          .  *  **:: *********:  *: **** **.:.*:*.*:**;****** *****..

ref|YP_146227.1|        KQELERRLLEAVKTLKIGNGLDETVKVGPVIHEEALQKIDRYVRIGVEEGAKLLVGGYIL
dbj|BAB39706.1|         KQEFERRLLEAVKTLKIGNGLDETVKVGPVIHEEALQKIDRYVRIGVEEGAKLLVGGYIL
ref|YP_001124476.1|     KQELEWRLLEAVKTLKIGDGLDETVKVGPVIHEEALQKIERYVHIGREEGAKLLVGGHIL
ref|ZP_01695767.1|      KDALEEKLIRRTAELKIGDGLDETVAVGPVINTEALNRIHQYVETGKKEGARLLTGGRIL
RAAC02986               EEALLARLLPRVQALRVGDGLDPAVNVGPVIHEEALAKIDRYVRLGVDEGARLLTGGRRL
ref|ZP_01723231.1|      KEQLENRLLDEMQKLTIGNGLDEGVKIGPVINKAALEKINHYVQIGKQEGATLLAGGRIL
                        ::  :     :*:      * :*:***  * :**:    :*.:**.  *  *  ** * ref|YP_146227.1|        REGDYARGFYYAPTIFTDVTPNMRIAREEIFGPVVSIISVRSLDEAIAVNNSVDYGLSSA
dbj|BAB39706.1|         REGDYARGFYYAPTIFTDVTPNMRIAREEIFGPVVSIISVRSLDEAIAVNNSVDYGLSSA
ref|YP_001124476.1|     SDGDYARGFYYAPTIFTDVTPDMRIAREEIFGPVVSIISVRSLDEAIAVNNCVDYGLSSA
ref|ZP_01695767.1|      P----GKGYYYAPTVFTDVSPEMVIAQEEIFGPVVSIIPVASLEEAIVVNNSVTFGLSSG
RAAC02986               TEGPLARGFYYAPTVFAGVRPDMRIAQEEIFGPVLCVMAVDSFEEAIRVNNGVRYGLSAS
ref|ZP_01723231.1|      NEPPYDNGFYYEPTLFTNVKPDMIIAQEEIFGPVVSLIEVASLEEAIEVNNGVKFGLSSS
                         .:** **:*:.* *:* **:***** :;; *  *::*** *** *  :***:.
```

FIG. 92B

```
ref|YP_146227.1|        IFTRDVNNVFRAMRDLDTGIVYVNAGTTGAEIHLPFGGTKGTGNGHRDSGVAALDVFTEW
dbj|BAB39706.1|         IFTRDVNNVFRAMRDLDTGIVYVNAGTTGAEIHLPFGGTKGTGNGHRDSGVAALDVFTEW
ref|YP_001124476.1|     IFTRDVNNVFRAMRDLDTGIVYVNAGTTGAEIHLPFGGTKGTGNGHRDSGVAALDVFTEW
ref|ZP_01695767.1|      IFTKDVNKAFQAMRDLDTGIVYINAGTTGAEIHLPFGGTKGTGNGHRDSGPAALDVYTEW
RAAC02986               IFTRDVNRVFRAMRDLDTGIVYVNAGTTGAEIHLPFGGTKATGNGHRDSGQAALDVFTEW
ref|ZP_01723231.1|      IFSQNVNTIFRAQRDLDTGIVYINAGTTGAEIHLPFGGTKGTGNGHRDSGVAALDVYTEW
                        ::.  *:* ******:***********.**** *:* ref|YP_146227.1|        RSIYVDFSGKLQRAQIDTD
dbj|BAB39706.1|         RSIYVDFSGKLQRAQIDTD
ref|YP_001124476.1|     RSIYVDFSGKLQRAQIDTD
ref|ZP_01695767.1|      KAVYVDFSGKLQRAQIDNN
RAAC02986               KTVYVDYSGRLQRAQIDNN
ref|ZP_01723231.1|      KSIYVDYSGKLQRAQID--
                        :::***:**:*******
```

FIG. 93

```
ref|YP_001127080.1|        ------------------------------------------AYREVKERLRGSIAPVVT
ref|YP_148885.1|           ------------------------------------------AYHEAKERLRGSIAPVVT
ref|YP_001374290.1|        ------------------------------------------------KLRGSIAPIIT
ref|NP_693789.1|           ------------------------------------------IKKRLRGSIAPVIT
RAAC03010                  MVAGRDGGHGLGTQRSRRTVRDDGRACGWVYQMRLRGGRVMGAEKDVYSRLRGSIVPMVT
ref|YP_144223.1|           ------------------------------------------------RGSIPPLPT
                                                                           ****  *:  * ref|YP_001127080.1|        PFDEEGNVDLTTLTSLIDWHIKSGTHGISVTGTSGEPSSLTLDERKQVMETAKKAVAGRV
ref|YP_148885.1|           PFDEEGNVDFAALAALIDWHIESGTHGISVTGTSGEPSSLTLEERKQVMETAKKAVAGRV
ref|YP_001374290.1|        PFDESGAIDFQTFENLIHWHIESGSHGISVTGTTGEPSSLKVEERVKVMETAAKAINGRV
ref|NP_693789.1|           PFKVNGDIDFKKQSELIEFQIENGTHAISVTGTSGEPSSLTTEERVQVMENAIKTINGRI
RAAC03010                  PFLEDGSFDEKSYRELIEWQIESGSHGISCAGTTGEPSSLTIEEREYLFEVTMDAVRGRV
ref|YP_144223.1|           PFRR-GRLDEEALRRLVERVVQGGSHGVSVGGTTGEPGTQTLEERKRAIEVVLDQVAGRV
                           **    *  *      *:.   ::.*:*.:*  **:***.:  . :**      :*  . .:  **:

ref|YP_001127080.1|        PFVPGTGSTNHAETIELTKFAQEIGADAAMVIVPYYNRPSQQALYKHFKAVAESV-DIPI
ref|YP_148885.1|           PFVPGTGSTNHAETIELTKFAQEIGADAAMVIVPYYNRPSQQALYKHFKAVAEAV-DIPI
ref|YP_001374290.1|        PFAPGTGSTNHEETLYLTKKAQEIGADAALVIVPYYNKPSQHALYKHFKTVADSV-DIPI
ref|NP_693789.1|           PFAPGTGSTNHDETMYVTKKAEEMGADAAMVIVPYYNKPNQEALYDHFKTVADSV-DIPI
RAAC03010                  PVVLGTGSTNHAEALRLTKTAERLGADAALVIVPYYNRPSQEGLYRHFRAIADSV-DIPI
ref|YP_144223.1|           PVIPGTGALRLEETLELTRFAKEAGAQGAMVIVPYYVKPNQEGLYRYFAEVARTVPDFPL
                           *.   ***.    *::  :*:  *:.  **:.*:******  :*.*..**  :*   :*  *:*:

ref|YP_001127080.1|        IVYNIPGRTAVNLEVKTLARLVEDCPNIIGVKESNKDFEHVNRVLWHCGRDFLLFSGIEL
ref|YP_148885.1|           IVYNIPGRTAVNLEVKTLARLAEDCPNIIGVKESNKDFEHVNRVLWHCGRDFLLFSGIEL
ref|YP_001374290.1|        IIYNIPGRTAVNLQVETIAKLNQDCPNIIGIKESNKDFEHINRVLLHCGRDFLLFSGIEL
ref|NP_693789.1|           IIYNIPGRTAQNMEVKTMARLVKDCPNIVGAKESNKDFEHVNRVLLNCGRDFLLFSGIEL
RAAC03010                  ILYNIPGRTGVNLEPATMARLKRDCRNIIGVKESNKDFEQVTRVFQACGRDFLVYSGIEL
ref|YP_144223.1|           LIYNIPGRAGVEIAPKTVGRLRRDFPNIVGLKHSSKDLEYLSHLFLEAGRDFLVFCGLES
                           ::******:.  ::    *::* .*  **:*  *.*.**:*  :.:::   .*****::.:* ref|YP_001127080.1|        LCYPMLAIGGAGSISATANVVPQKVAELHDAWFDGDVKRAQDLHFELMELNDVLFIETNP
ref|YP_148885.1|           LCYPMLAIGGAGSISATANVVPHKVAELHDAWFEGDIKRAQDLHFELMELNDVLFIETNP
ref|YP_001374290.1|        LCYPMLAIGGAGHISATANVAPKQVAEVYNAWNEGDIKRALTLHYELMPLNDVLFKDTNP
ref|NP_693789.1|           LCYPMLAIGGAGSISATANVEPKKVAEMHNAWEEGDIKRAQDLHFELMNLNDVLFKDTNP
RAAC03010                  LCYPMLALGGAGHLSATANLMPREVARLYDLVQAGKWHEAIDLHFQLVDINEALFWETNP
ref|YP_144223.1|           LTLPMMSLGAVGTIAATANWLPKEVALLCEKALAGDYQGARELHFHLLEANEAIFWDTNP
                           *  **::*..*  ::****   *:*:**   *:  : :     *.  :   :.*:   *:..*  :*** ref|YP_001127080.1|        GPVKAALGMLGKITPKLRLPLDLPSEEHQEQIRRTLVKYGLL
ref|YP_148885.1|           GPVKAALGMMGKITPKLRLPLDLPSEEHQQQIRRTLVKYGLL
ref|YP_001374290.1|        APVKAALGMMGKIKPVLRLPMDVPSQELQDEIRDVLKNY---
ref|NP_693789.1|           APVKAALGMMGMIEPVLRRPMGLPSDALQEEIRDTLVKYGKI
RAAC03010                  GPVKACLAMMGKIRPVVRPPLALPGEEMTAKLRGVLTSYGLI
ref|YP_144223.1|           IPLKTVLSWMGLLEKEWRPPLGPTTPEVEERLRRMAERYGLL
                            *:*:  *. *:*   :        *  *:  .     .:*      *
```

US 8,728,803 B2

THERMOPHILIC AND THERMOACIDOPHILIC METABOLISM GENES AND ENZYMES FROM *ALICYCLOBACILLUS ACIDOCALDARIUS* AND RELATED ORGANISMS, METHODS

CROSS-REFERENCE TO RELATED APPLICATION

This application claims the benefit of the filing date of U.S. Provisional Patent Application Ser. No. 61/032,339, filed Feb. 28, 2008, for "THERMOPHILIC AND THERMOACIDOPHILIC METABOLISM GENES AND ENZYMES FROM *ALICYCLOBACILLUS ACIDOCALDARIUS* AND RELATED ORGANISMS, METHODS."

GOVERNMENT RIGHTS

This invention was made with government support under Contract Number DE-AC07-991D13727 and Contract Number DE-AC07-051D14517 awarded by the United States Department of Energy. The government has certain rights in the invention.

STATEMENT ACCORDING TO 37 C.F.R. §1.52(e)(5)—SEQUENCE LISTING SUBMITTED ON COMPACT DISC

Pursuant to 37 C.F.R. §1.52(e)(1)(ii), a compact disc containing an electronic version of the Sequence Listing has been submitted concomitant with this application, the contents of which are hereby incorporated by reference. A second compact disc is submitted and is an identical copy of the first compact disc. The discs are labeled "COPY 1 REPLACEMENT 06/29/2009" and "COPY 2 REPLACEMENT 06/29/2009," respectively, and each disc contains one file entitled "Replacement Utility BA-293 Sequence List III.txt" which is 4,701 KB and created on Jun. 29, 2009.

TECHNICAL FIELD

The present invention relates generally to biotechnology. More specifically, embodiments of the present invention relate to isolated and/or purified polypeptides and nucleic acid sequences encoding polypeptides from *Alicyclobacillus acidocaldarius* and methods for their use.

BACKGROUND

Enzymes have a great deal of potential for production of useful chemicals in industrial processes. However, industrial processes typically occur at extremes of temperature, pH, salt, etc., to which most of the well-studied enzymes and organisms are not well suited.

BRIEF SUMMARY OF THE INVENTION

Embodiments of the invention relate to purified and/or isolated nucleotide sequences of the genome of *Alicyclobacillus acidocaldarius*, or a homologue or fragment thereof. In one embodiment of the invention, the nucleotide sequence is selected from at least one of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 or a homologue or fragment thereof. In another embodiment of the invention, the homologue is selected from the group consisting of a nucleotide sequence having at least 80% sequence identity to at least one of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566.

Embodiments of the invention may further relate to an isolated and/or purified nucleic acid sequence comprising a nucleic acid sequence encoding a polypeptide selected from the group consisting of a polypeptide having at least 90% sequence identity to at least one of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565.

Embodiments of the invention also relate to isolated and/or purified polypeptides coded for by a nucleotide sequence comprising a nucleotide sequence of the genome of *Alicyclobacillus acidocaldarius*, or a homologue or fragment thereof. In one embodiment, the nucleotide sequence comprises a nucleotide sequence selected from the group consisting of a nucleotide sequence having at least 80% sequence identity to at least one of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566.

In another embodiment of the invention, the nucleotide sequence comprises a nucleotide sequence selected from at least one of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 or a homologue or fragment thereof. In still another embodiment, the polypeptide comprises an amino acid sequence of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565. In yet another embodiment, the polypeptide comprises an amino acid sequence selected from the group consisting of a polypeptide having at least 90% sequence identity to at least one of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565.

In embodiments of the invention, the polypeptides may be acidophilic and/or thermophilic. In further embodiments, the polypeptides may be glycosylated, pegylated, and/or otherwise post-translationally modified.

Embodiments of methods include methods of altering metabolism in a cell, the methods comprising providing a recombinant, purified, and/or isolated nucleotide sequence comprising a nucleotide sequence selected from the group consisting of a nucleotide sequence having at least 90% sequence identity to at least one of the sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 to the cell.

Further embodiments of methods include placing a cell producing or encoding a recombinant, purified, and/or isolated nucleotide sequence comprising a nucleotide sequence selected from the group consisting of a nucleotide sequence having at least 90% sequence identity to at least one of the sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 in an environment comprising temperatures at or above about 25, 30, 35, 40, 45, 50, 55, 60, 65, 70, 75, 80, 85, 90, and/or 95 degrees Celsius and/or a pH at, below, and/or above 8, 7, 6, 5, 4, 3, 2, 1, and/or 0.

These and other aspects of the invention will become apparent to the skilled artisan in view of the teachings contained herein.

BRIEF DESCRIPTION OF THE SEVERAL VIEWS OF THE DRAWINGS

FIGS. 1A and 1B depict a sequence alignment between SEQ ID NO:1 (RAAC00079) and ref|YP_074710.1|, ref|YP_359514.1|, ref|YP_516748.1|, ref|YP_643635.1|, and ref|YP_144514.1| (SEQ ID NOS:3-7 respectively), which all have the function assigned to SEQ ID NO:1 in Table 1. Amino acids conserved among all sequences are indicted by a "*" and generally conserved amino acids are indicated by a ":".

FIG. 2 depicts a sequence alignment between SEQ ID NO:18 (RAAC00455) and gb|ABE97159.1|, ref|NP_693902.1|, ref|YP_521150.1|, ref|ZP_01725542.11, and ref|ZP_01666741.1| (SEQ ID NOS:20-24 respectively), which all have the function assigned to SEQ ID NO:18 in Table 1. Amino acids conserved among all sequences are indicted by a "*" and generally conserved amino acids are indicated by a ":".

FIGS. 3A and 3B depict a sequence alignment between SEQ ID NO:35 (RAAC00461) and ref|YP_361350.1|, ref|NP_244632.1|, ref|ZP_00538452.1|, ref|YP_001127398.1|, and ref|YP_149222.1| (SEQ ID NOS:37-41 respectively), which all have the function assigned to SEQ ID NO:35 in Table 1. Amino acids conserved among all sequences are indicted by a "*" and generally conserved amino acids are indicated by a ":".

FIG. 4 depicts a sequence alignment between SEQ ID NO:52 (RAAC00481) and ref|NP_905294.1|, ref|ZP_01666099.1|, ref|YP_360429.1|, ref|YP_754604.1|, and ref|YP_384529.1| (SEQ ID NOS:54-58 respectively), which all have the function assigned to SEQ ID NO:52 in Table 1. Amino acids conserved among all sequences are indicted by a "*" and generally conserved amino acids are indicated by a ":".

FIG. 5 depicts a sequence alignment between SEQ ID NO:69 (RAAC00529) and ref|YP_146903.1|, ref|YP_001125035.1|, ref|YP_001646604.1|, ref|YP_001375911.1|, and ref|ZP_01696300.1| (SEQ ID NOS:71-75 respectively), which all have the function assigned to SEQ ID NO:69 in Table 1. Amino acids conserved among all sequences are indicted by a "*" and generally conserved amino acids are indicated by a ":".

FIG. 6 depicts a sequence alignment between SEQ ID NO:86 (RAAC00552) and ref|YP_001376041.1|, dbj|BAB39458.1|, ref|NP_846569.1|, ref|YP_896466.1|, and ref|ZP_00238879.1| (SEQ ID NOS:88-92 respectively), which all have the function assigned to SEQ ID NO:86 in Table 1. Amino acids conserved among all sequences are indicted by a "*" and generally conserved amino acids are indicated by a ":".

FIG. 7 depicts a sequence alignment between SEQ ID NO:103 (RAAC00553) and ref|YP_001646745.1|, ref|YP_001376045.1|, ref|NP_833836.1|, ref|ZP_00739346.1|, and ref|YP_085454.1| (SEQ ID NOS:105-109 respectively), which all have the function assigned to SEQ ID NO:103 in Table 1. Amino acids conserved among all sequences are indicted by a "*" and generally conserved amino acids are indicated by a ":".

FIG. 8 depicts a sequence alignment between SEQ ID NO:120 (RAAC00554) and ref|YP_147981.1|, ref|NP_390900.1|, ref|ZP_01667656.1|, sp|P22806|BIOF_BACSH, and dbj|BAB39457.1| (SEQ ID NOS:122-126 respectively), which all have the function assigned to SEQ ID NO:120 in Table 1. Amino acids conserved among all sequences are indicted by a "*" and generally conserved amino acids are indicated by a ":".

FIG. 9 depicts a sequence alignment between SEQ ID NO:137 (RAAC00632) and ref|YP_001126681.1|, ref|YP_148515.1|, ref|ZP_01171798.1|, ref|YP_001374758.1|, and ref|YP_080106.1| (SEQ ID NOS:139-143 respectively), which all have the function assigned to SEQ ID NO:137 in Table 1. Amino acids conserved among all sequences are indicted by a "*" and generally conserved amino acids are indicated by a ":".

FIGS. 10A and 10B depict a sequence alignment between SEQ ID NO:154 (RAAC00633) and ref|NP_243928.1|, ref|ZP_01695378.1|, ref|ZP_01725506.1|, ref|YP_176142.1|, and ref|YP_850199.1| (SEQ ID NOS:156-160 respectively), which all have the function assigned to SEQ ID NO:154 in Table 1. Amino acids conserved among all sequences are indicted by a "*" and generally conserved amino acids are indicated by a ":".

FIGS. 11A and 11B depict a sequence alignment between SEQ ID NO:171 (RAAC00634) and ref|YP_001126680.1|, ref|YP_001487695.1|, ref|YP_148514.1|, gb|AAL99356.1|, and ref|YP_176141.1| (SEQ ID NOS: 173-177 respectively), which all have the function assigned to SEQ ID NO:171 in Table 1. Amino acids conserved among all sequences are indicted by a "*" and generally conserved amino acids are indicated by a ":".

FIG. 12 depicts a sequence alignment between SEQ ID NO:188 (RAAC00174) and ref|YP_175798.1|, ref|NP_243358.1|, ref|NP_389472.1|, ref|ZP_01861659.1|, and ref|YP_147042.1| (SEQ ID NOS:190-194 respectively), which all have the function assigned to SEQ ID NO:188 in Table 1. Amino acids conserved among all sequences are indicted by a "*" and generally conserved amino acids are indicated by a ":".

FIG. 13 depicts a sequence alignment between SEQ ID NO:205 (RAAC00635) and ref|YP_148513.1|, ref|NP_243926.1|, ref|YP_001126679.1|, ref|YP_176140.1|, and ref|NP_843875.1| (SEQ ID NOS:207-211 respectively), which all have the function assigned to SEQ ID NO:205 in Table 1. Amino acids conserved among all sequences are indicted by a "*" and generally conserved amino acids are indicated by a ":".

FIG. 14 depicts a sequence alignment between SEQ ID NO:222 (RAAC00637) and ref|NP_243923.1|, ref|YP_148510.1|, ref|ZP_01171803.1|, ref|YP_001126676.1|, and ref|NP_926497.1| (SEQ ID NOS:224-228 respectively), which all have the function assigned to SEQ ID NO:222 in Table 1. Amino acids conserved among all sequences are indicted by a "*" and generally conserved amino acids are indicated by a ":".

FIGS. 15A and 15B depict a sequence alignment between SEQ ID NO:239 (RAAC00638) and ref|NP_243922.1|, ref|YP_148509.1|, ref|YP_001126675.1|, ref|ZP_01171804.1|, and ref|YP_075945.1| (SEQ ID NOS:241-245 respectively), which all have the function assigned to SEQ ID NO:239 in Table 1. Amino acids conserved among all sequences are indicted by a "*" and generally conserved amino acids are indicated by a ":".

FIG. 16 depicts a sequence alignment between SEQ ID NO:256 (RAAC00639) and sp|Q67MJ3|LEUD_SYMTH, ref|YP_148508.1|, ref|YP_001126674.1|, ref|YP_080099.1|, and ref|YP_001487689.1| (SEQ ID NOS:258-262 respectively), which all have the function assigned to SEQ ID NO:256 in Table 1. Amino acids conserved among all sequences are indicted by a "*" and generally conserved amino acids are indicated by a ":".

FIGS. 17A and 17B depict a sequence alignment between SEQ ID NO:273 (RAAC00642) and ref|YP_826036.1|, gb|ABV27286.1|, gb|AAL17866.1|AF424980_1, ref|ZP_01859643.1|, and ref|NP_244026.1| (SEQ ID NOS:275-279 respectively), which all have the function assigned to SEQ ID NO:273 in Table 1. Amino acids conserved among all sequences are indicted by a "*" and generally conserved amino acids are indicated by a ":".

FIGS. 18A-18C depict a sequence alignment between SEQ ID NO:290 (RAAC00727) and ref|YP_001637294.1|, ref|ZP_01516643.1|, ref|YP_645264.1|, ref|YP_146876.1|, and ref|YP_001125008.1| (SEQ ID NOS:292-296 respectively), which all have the function assigned to SEQ ID NO:290 in Table 1. Amino acids conserved among all sequences are indicted by a "*" and generally conserved amino acids are indicated by a ":".

FIGS. 19A and 19B depict a sequence alignment between SEQ ID NO:307 (RAAC00729) and ref|YP_001125365.1|, ref|YP_147249.1|, ref|ZP_01695431.1|, ref|NP_244828.1|, and ref|YP_895448.1| (SEQ ID NOS:309-313 respectively), which all have the function assigned to SEQ ID NO:307 in Table 1. Amino acids conserved among all sequences are indicted by a "*" and generally conserved amino acids are indicated by a ":".

FIGS. 20A and 20B depict a sequence alignment between SEQ ID NO:324 (RAAC00730) and ref|YP_075148.1|, sp|P16468|MAOX_BACST, ref|YP_147293.1|, ref|YP_643888.1|, and ref|YP_001125416.1| (SEQ ID NOS:326-330 respectively), which all have the function assigned to SEQ ID NO:324 in Table 1. Amino acids conserved among all sequences are indicted by a "*" and generally conserved amino acids are indicated by a ":".

FIGS. 21A-21C depict a sequence alignment between SEQ ID NO:341 (RAAC00735) and ref|ZP_01696337.1|, ref|ZP_02171753.1, ref|YP_284976.1|, ref|YP_001546997.1|, and ref|YP_001277075.1| (SEQ ID NOS: 343-347 respectively), which all have the function assigned to SEQ ID NO:341 in Table 1. Amino acids conserved among all sequences are indicted by a "*" and generally conserved amino acids are indicated by a ":".

FIG. 22 depicts a sequence alignment between SEQ ID NO:358 (RAAC00812) and ref|ZP_00539373.1|, ref|YP_386234.1|, ref|YP_001378696.1|, ref|ZP_01723286.1|, and ref|NP_391778.1| (SEQ ID NOS:360-364 respectively), which all have the function assigned to SEQ ID NO:358 in Table 1. Amino acids conserved among all sequences are indicted by a "*" and generally conserved amino acids are indicated by a ":".

FIGS. 23A and 23B depict a sequence alignment between SEQ ID NO:375 (RAAC00196) and ref|YP_147293.1|, sp|P16468|MAOX_BACST, ref|YP_643888.1|, ref|YP_075148.1|, and ref|YP_001125416.1| (SEQ ID NOS:377-381 respectively), which all have the function assigned to SEQ ID NO:375 in Table 1. Amino acids conserved among all sequences are indicted by a "*" and generally conserved amino acids are indicated by a ":".

FIG. 24 depicts a sequence alignment between SEQ ID NO:392 (RAAC00814) and ref|YP_360188.1|, ref|ZP_01666093.1|, ref|NP_242895.1|, ref|YP_360122.1|, and ref|ZP_01372991.1| (SEQ ID NOS:394-398 respectively), which all have the function assigned to SEQ ID NO:392 in FIGS. 25A and 25B depict a sequence alignment between SEQ ID NO:409 (RAAC00815) and ref|YP_644483.1|, ref|NP_294183.1|, ref|YP_359514.1|, ref|YP_605214.1|, and ref|YP_592595.1| (SEQ ID NOS:411-415 respectively), which all have the function assigned to SEQ ID NO:409 in Table 1. Amino acids conserved among all sequences are indicted by a "*" and generally conserved amino acids are indicated by a ":".

FIG. 26 depicts a sequence alignment between SEQ ID NO:426 (RAAC00816) and ref|YP_147450.1|, ref|YP_001125561.1|, ref|ZP_01696479.1|, ref|NP_241996.1|, and ref|YP_079308.1| (SEQ ID NOS:428-432 respectively), which all have the function assigned to SEQ ID NO:426 in Table 1. Amino acids conserved among all sequences are indicted by a "*" and generally conserved amino acids are indicated by a ":".

FIG. 27 depicts a sequence alignment between SEQ ID NO:443 (RAAC00822) and ref|ZP_00539140.1|, ref|ZP_02130394.1|, ref|NP_241073.1|, ref|ZP_01696475.1|, and dbj|BAA75325.1| (SEQ ID NOS:445-449 respectively), which all have the function assigned to SEQ ID NO:443 in Table 1. Amino acids conserved among all sequences are indicted by a "*" and generally conserved amino acids are indicated by a ":".

FIGS. 28A-28C depict a sequence alignment between SEQ ID NO:460 (RAAC00950) and ref|YP_001420821.1|, ref|ZP_01696606.1|, ref|ZP_01171726.1|, ref|NP_389098.1|, and ref|YP_091797.1| (SEQ ID NOS:462-466 respectively), which all have the function assigned to SEQ ID NO:460 in Table 1. Amino acids conserved among all sequences are indicted by a "*" and generally conserved amino acids are indicated by a ":".

FIG. 29 depicts a sequence alignment between SEQ ID NO:477 (RAAC00952) and ref|YP_146314.1|, ref|YP_001124593.1|, ref|NP_830405.1|, ref|ZP_00739906.1|, and ref|NP_391552.1| (SEQ ID NOS:479-483 respectively), which all have the function assigned to SEQ ID NO:477 in Table 1. Amino acids conserved among all sequences are indicted by a "*" and generally conserved amino acids are indicated by a ":".

FIG. 30 depicts a sequence alignment between SEQ ID NO:494 (RAAC00990) and ref|YP_148038.1|, ref|YP_001126216.1|, ref|NP_242546.1|, ref|ZP_01697215.1|, and ref|YP_175412.1| (SEQ ID NOS:496-500 respectively), which all have the function assigned to SEQ ID NO:494 in Table 1. Amino acids conserved among all sequences are indicted by a "*" and generally conserved amino acids are indicated by a ":".

FIG. 31 depicts a sequence alignment between SEQ ID NO:511 (RAAC01029) and ref|YP_001132791.1|, ref|YP_890165.1|, ref|YP_704478.1|, ref|YP_956012.1|, and ref|YP_879906.21 (SEQ ID NOS:513-517 respectively), which all have the function assigned to SEQ ID NO:511 in Table 1. Amino acids conserved among all sequences are indicted by a "*" and generally conserved amino acids are indicated by a ":".

FIGS. 32A-32C depict a sequence alignment between SEQ ID NO:528 (RAAC01041) and ref|YP_359304.1|, ref|ZP_01697277.1|, ref|YP_519313.1|, ref|ZP_01370069.1|, and ref|YP_429480.1| (SEQ ID NOS:530-534 respectively), which all have the function assigned to SEQ ID NO:528 in Table 1. Amino acids conserved among all sequences are indicted by a "*" and generally conserved amino acids are indicated by a ":".

FIGS. 33A and 33B depict a sequence alignment between SEQ ID NO:545 (RAAC01057) and ref|YP_148861.1|, ref|YP_076839.1|, ref|NP_244355.1|, ref|ZP_01697463.1|, and ref|ZP_01173543.1| (SEQ ID NOS:547-551 respectively), which all have the function assigned to SEQ ID NO:545 in Table 1. Amino acids conserved among all sequences are indicted by a "*" and generally conserved amino acids are indicated by a ":".

FIG. 34 depicts a sequence alignment between SEQ ID NO:562 (RAAC00352) and ref|NP_691707.1|, ref|YP_829756.1|, ref|YP_947785.1|, ref|YP_001221402.1|, and ref|YP_885435.1| (SEQ ID NOS:564-568 respectively), which all have the function assigned to SEQ ID NO:562 in Table 1. Amino acids conserved among all sequences are indicted by a "*" and generally conserved amino acids are indicated by a ":".

FIG. 35 depicts a sequence alignment between SEQ ID NO:579 (RAAC04321) and gb|ABW71834.1|, ref|YP_055250.1|, ref|YP_612035.1|, ref|YP_134751.1|, and ref|ZP_01441442.1| (SEQ ID NOS:581-585 respectively), which all have the function assigned to SEQ ID NO:579 in Table 1. Amino acids conserved among all sequences are indicted by a "*" and generally conserved amino acids are indicated by a ":".

FIG. 36 depicts a sequence alignment between SEQ ID NO:596 (RAAC04349) and ref|YP_917551.1|, ref|ZP_00631342.1|, ref|YP_001259911.1|, ref|NP_105797.1|, and ref|ZP_00998521.1 (SEQ ID NOS:598-602 respectively), which all have the function assigned to SEQ ID NO:596 in Table 1. Amino acids conserved among all sequences are indicated by a "*" and generally conserved amino acids are indicated by a ":".

FIGS. 37A and 37B depict a sequence alignment between SEQ ID NO:613 (RAAC01327) and emb|CAD30313.1|, ref|ZP_01697379.1|, ref|YP_001375474.1|, ref|NP_833288.1|, and ref|NP_979866.1| (SEQ ID NOS:615-619 respectively), which all have the function assigned to SEQ ID NO:613 in Table 1. Amino acids conserved among all sequences are indicated by a "*" and generally conserved amino acids are indicated by a ":".

FIGS. 38A and 38B depict a sequence alignment between SEQ ID NO:630 (RAAC01351) and ref|YP_001125497.1|, ref|YP_175672.1|, ref|NP_243001.1|, ref|YP_147384.1|, and ref|YP_001108459.1| (SEQ ID NOS:632-636 respectively), which all have the function assigned to SEQ ID NO:630 in Table 1. Amino acids conserved among all sequences are indicated by a "*" and generally conserved amino acids are indicated by a ":".

FIGS. 39A and 39B depict a sequence alignment between SEQ ID NO:647 (RAAC01352) and ref|YP_147385.1|, ref|YP_001125498.1|, ref|YP_175671.1|, ref|NP_926015.1|, and ref|YP_001660274.1| (SEQ ID NOS:649-653 respectively), which all have the function assigned to SEQ ID NO:647 in Table 1. Amino acids conserved among all sequences are indicated by a "*" and generally conserved amino acids are indicated by a ":".

FIGS. 40A and 40B depict a sequence alignment between SEQ ID NO:664 (RAAC01354) and ref|YP_001636557.1|, ref|ZP_01517435.1|, ref|ZP_01697170.1|, ref|YP_001374183.1|, and ref|YP_082630.1| (SEQ ID NOS:666-670 respectively), which all have the function assigned to SEQ ID NO:664 in Table 1. Amino acids conserved among all sequences are indicated by a "*" and generally conserved amino acids are indicated by a ":".

FIGS. 41A and 41B depict a sequence alignment between SEQ ID NO:681 (RAAC01360) and ref|ZP_01724857.1|, ref|ZP_00235684.1|, ref|YP_895924.1|, ref|YP_

037600.1|, and ref|YP_001646030.1| (SEQ ID NOS:683-687 respectively), which all have the function assigned to SEQ ID NO:681 in Table 1. Amino acids conserved among all sequences are indicted by a "*" and generally conserved amino acids are indicated by a ":".

FIG. 42 depicts a sequence alignment between SEQ ID NO:698 (RAAC01408) and ref|YP_872951.1|, gb|AAQ84159.1|, ref|YP_701593.1|, ref|YP_885121.1|, and ref|ZP_02169377.1| (SEQ ID NOS:700-704 respectively), which all have the function assigned to SEQ ID NO:698 in Table 1. Amino acids conserved among all sequences are indicted by a "*" and generally conserved amino acids are indicated by a ":".

FIG. 43 depicts a sequence alignment between SEQ ID NO:715 (RAAC01425) and ref|YP_146050.1|, ref|YP_001124307.1|, ref|YP_360564.1|, ref|NP_691609.1|, and ref|NP_294646.1| (SEQ ID NOS:717-721 respectively), which all have the function assigned to SEQ ID NO:715 in Table 1. Amino acids conserved among all sequences are indicted by a "*" and generally conserved amino acids are indicated by a ":".

FIG. 44 depicts a sequence alignment between SEQ ID NO:732 (RAAC01517) and ref|YP_902570.1|, ref|YP_076319.1|, ref|YP_001629366.1|, ref|ZP_01667660.1|, and ref|YP_429281.1| (SEQ ID NOS:734-738 respectively), which all have the function assigned to SEQ ID NO:732 in Table 1. Amino acids conserved among all sequences are indicted by a "*" and generally conserved amino acids are indicated by a ":".

FIG. 45 depicts a sequence alignment between SEQ ID NO:749 (RAAC00449) and ref|ZP_01666747.1|, pdb|2QE7|H, sp|P22480|ATPE_BACPF, ref|ZP_01188594.1|, and ref|YP_521144.1| (SEQ ID NOS:751-755 respectively), which all have the function assigned to SEQ ID NO:749 in Table 1. Amino acids conserved among all sequences are indicted by a "*" and generally conserved amino acids are indicated by a ":".

FIGS. 46A and 46B depict a sequence alignment between SEQ ID NO:766 (RAAC01555) and ref|YP_079644.1|, sp|P23630|DCDA_BACSU, ref|NP_390219.1|, ref|YP_001421740.1|, and ref|YP_001487298.1| (SEQ ID NOS: 768-772 respectively), which all have the function assigned to SEQ ID NO:766 in Table 1. Amino acids conserved among all sequences are indicted by a "*" and generally conserved amino acids are indicated by a ":".

FIGS. 47A and 47B depict a sequence alignment between SEQ ID NO:783 (RAAC01575) and ref|NP_241871.1|, ref|YP_077980.1|, ref|YP_001420375.1|, ref|NP_388616.1|, and ref|NP_693628.1| (SEQ ID NOS:785-789 respectively), which all have the function assigned to SEQ ID NO:783 in Table 1. Amino acids conserved among all sequences are indicted by a "*" and generally conserved amino acids are indicated by a ":".

FIG. 48 depicts a sequence alignment between SEQ ID NO:800 (RAAC01657) and dbj|BAB40585.1|, ref|NP_241079.1|, ref|YP_001126012.1|, ref|ZP_01171269.1|, and ref|P_01860561.1| (SEQ ID NOS:802-806 respectively), which all have the function assigned to SEQ ID NO:800 in Table 1. Amino acids conserved among all sequences are indicted by a "*" and generally conserved amino acids are indicated by a ":".

FIG. 49 depicts a sequence alignment between SEQ ID NO:817 (RAAC01658) and ref|NP_241080.1|, dbj|BAB40586.1|, ref|YP_001126011.1|, ref|NP_693798.1|, and ref|ZP_00539126.1| (SEQ ID NOS:819-823 respectively), which all have the function assigned to SEQ ID NO:817 in Table 1. Amino acids conserved among all sequences are indicted by a "*" and generally conserved amino acids are indicated by a ":".

FIG. 50 depicts a sequence alignment between SEQ ID NO:834 (RAAC01669) and ref|YP_001125402.1|, ref|YP_147282.1|, ref|ZP_01859257.1|, ref|NP_388913.1|, and ref|YP_001420249.1| (SEQ ID NOS:836-840 respectively), which all have the function assigned to SEQ ID NO:834 in Table 1. Amino acids conserved among all sequences are indicted by a "*" and generally conserved amino acids are indicated by a ":".

FIGS. 51A-51C depict a sequence alignment between SEQ ID NO:851 (RAAC01678) and ref|ZP_01696606.1|, ref|YP_146312.1|, ref|ZP_01171726.1|, ref|YP_001124591.1|, and ref|ZP_01696079.1| (SEQ ID NOS:853-857 respectively), which all have the function assigned to SEQ ID NO:851 in Table 1. Amino acids conserved among all sequences are indicted by a "*" and generally conserved amino acids are indicated by a ":".

FIGS. 52A and 52B depict a sequence alignment between SEQ ID NO:868 (RAAC01685) and ref|YP_431081.1|, ref|YP_001211085.1|, ref|YP_001111663.1|, ref|YP_001547204.1|, and ref|NP_213242.1| (SEQ ID NOS:870-874 respectively), which all have the function assigned to SEQ ID NO:868 in Table 1. Amino acids conserved among all sequences are indicted by a "*" and generally conserved amino acids are indicated by a ":".

FIG. 53 depicts a sequence alignment between SEQ ID NO:885 (RAAC01745) and ref|YP_001127228.1|, ref|YP_149070.1|, ref|ZP_00539127.1|, ref|NP_241079.1|, and ref|YP_074240.1| (SEQ ID NOS:887-891 respectively), which all have the function assigned to SEQ ID NO:885 in Table 1. Amino acids conserved among all sequences are indicted by a "*" and generally conserved amino acids are indicated by a ":".

FIG. 54 depicts a sequence alignment between SEQ ID NO:902 (RAAC01746) and ref|YP_149069.1|, ref|YP_001127227.1|, ref|ZP_00539126.1|, ref|YP_001125046.1|, and ref|NP_833691.1| (SEQ ID NOS:904-908 respectively), which all have the function assigned to SEQ ID NO:902 in Table 1. Amino acids conserved among all sequences are indicted by a "*" and generally conserved amino acids are indicated by a ":".

FIG. 55 depicts a sequence alignment between SEQ ID NO:919 (RAAC01748) and ref|NP_828658.1|, emb|CAJ88521.1|, ref|NP_625066.1|, ref|YP_001104836.1|, and ref|YP_658557.1| (SEQ ID NOS:921-925 respectively), which all have the function assigned to SEQ ID NO:919 in Table 1. Amino acids conserved among all sequences are indicted by a "*" and generally conserved amino acids are indicated by a ":".

FIGS. 56A and 56B depict a sequence alignment between SEQ ID NO:936 (RAAC00450) and pdb|2QE7|D, sp|Q9LA80|ATPB_GEOTH, ref|YP_149211.1|, sp|P41009|ATPB_BACCA, and prf||1211283A (SEQ ID NOS:938-942 respectively), which all have the function assigned to SEQ ID NO:936 in Table 1. Amino acids conserved among all sequences are indicted by a "*" and generally conserved amino acids are indicated by a ":".

FIGS. 57A-57C depict a sequence alignment between SEQ ID NO:953 (RAAC01759) and ref|ZP_02170376.1|, ref|YP_001546865.1|, ref|YP_001125323.1|, ref|YP_147200.2|, and ref|YP_091630.1| (SEQ ID NOS:955-959 respectively), which all have the function assigned to SEQ ID NO:953 in Table 1. Amino acids conserved among all sequences are indicted by a "*" and generally conserved amino acids are indicated by a ":".

FIG. 58 depicts a sequence alignment between SEQ ID NO:970 (RAAC01762) and gb|ABW71834.1|, ref|ZP_02015336.1|, ref|YP_055250.1|, ref|YP_136548.1|, and ref|NP_102793.1| (SEQ ID NOS:972-976 respectively), which all have the function assigned to SEQ ID NO:970 in Table 1. Amino acids conserved among all sequences are indicted by a "*" and generally conserved amino acids are indicated by a ":".

FIG. 59 depicts a sequence alignment between SEQ ID NO:987 (RAAC01763) and ref|YP_300327.1|, ref|NP_693723.1|, ref|YP_190012.1|, ref|YP_252288.1|, and ref|ZP_01227084.1| (SEQ ID NOS:989-993 respectively), which all have the function assigned to SEQ ID NO:987 in Table 1. Amino acids conserved among all sequences are indicted by a "*" and generally conserved amino acids are indicated by a ":".

FIG. 60 depicts a sequence alignment between SEQ ID NO:1004 (RAAC01767) and ref|ZP_01860323.1|, ref|NP_244450.1|, ref|YP_148929.1|, ref|YP_080823.1|, and ref|ZP_01171654.1| (SEQ ID NOS:1006-1010 respectively), which all have the function assigned to SEQ ID NO:1004 in Table 1. Amino acids conserved among all sequences are indicted by a and generally conserved amino acids are indicated by a ":".

FIG. 61 depicts a sequence alignment between SEQ ID NO:1021 (RAAC01797) and ref|YP_076186.1|, ref|NP_691214.1|, ref|ZP_01170331.1|, ref|NP_388333.1|, and ref|YP_001375327.1| (SEQ ID NOS:1023-1027 respectively), which all have the function assigned to SEQ ID NO:1021 in Table 1. Amino acids conserved among all sequences are indicted by a and generally conserved amino acids are indicated by a ":".

FIGS. 62A and 62B depict a sequence alignment between SEQ ID NO:1038 (RAAC01900) and ref|NP_691405.1|, ref|NP_242876.1|, ref|NP_241871.1|, ref|YP_001420375.1|, and ref|NP_388616.1| (SEQ ID NOS:1040-1044 respectively), which all have the function assigned to SEQ ID NO:1038 in Table 1. Amino acids conserved among all sequences are indicted by a "*" and generally conserved amino acids are indicated by a ":".

FIG. 63 depicts a sequence alignment between SEQ ID NO:1055 (RAAC01939) and ref|NP_390790.1|, ref|ZP_02170616.1, ref|NP_693087.1|, ref|YP_080204.1|, and sp|Q59202|MDH_BACIS (SEQ ID NOS:1057-1061 respectively), which all have the function assigned to SEQ ID NO:1055 in Table 1. Amino acids conserved among all sequences are indicted by a "*" and generally conserved amino acids are indicated by a ":".

FIG. 64 depicts a sequence alignment between SEQ ID NO:1072 (RAAC01996) and ref|NP_244279.1|, ref|YP_001126997.1|, ref|YP_148810.1|, ref|YP_001488092.1|, and ref|NP_391097.1| (SEQ ID NOS:1074-1078 respectively), which all have the function assigned to SEQ ID NO:1072 Table 1. Amino acids conserved among all sequences are indicted by a "*" and generally conserved amino acids are indicated by a ":".

FIG. 65 depicts a sequence alignment between SEQ ID NO:1089 (RAAC02025) and ref|NP_390723.1|, ref|YP_080139.1|, ref|YP_001422141.1|, ref|ZP_01171785.1|, and ref|NP_243959.1| (SEQ ID NOS:1091-1095 respectively), which all have the function assigned to SEQ ID NO:1089 in Table 1. Amino acids conserved among all sequences are indicted by a "*" and generally conserved amino acids are indicated by a ":".

FIG. 66 depicts a sequence alignment between SEQ ID NO:1106 (RAAC00451) and pdb|2QE7|G, ref|YP_001127389.1|, ref|YP_149212.1|, ref|YP_001488540.1|, and emb|CAA30654.11 (SEQ ID NOS:1108-1112 respectively), which all have the function assigned to SEQ ID NO:1106 in Table 1. Amino acids conserved among all sequences are indicted by a "*" and generally conserved amino acids are indicated by a ":".

FIGS. 67A and 67B depict a sequence alignment between SEQ ID NO:1123 (RAAC02026) and ref|YP_148525.1|, ref|YP_001126690.1|, emb|CAA69872.1|, ref|YP_092553.1|, and ref|NP_243958.1| (SEQ ID NOS:1125-1129 respectively), which all have the function assigned to SEQ ID NO:1123 in Table 1. Amino acids conserved among all sequences are indicted by a "*" and generally conserved amino acids are indicated by a ":".

FIG. 68 depicts a sequence alignment between SEQ ID NO:1140 (RAAC02027) and emb|CAA69873.1|, ref|YP_148524.1|, ref|YP_080136.1|, ref|NP_243957.1|, and ref|ZP_01697535.1| (SEQ ID NOS:1142-1146 respectively), which all have the function assigned to SEQ ID NO:1140 in Table 1. Amino acids conserved among all sequences are indicted by a and generally conserved amino acids are indicated by a ":".

FIG. 69 depicts a sequence alignment between SEQ ID NO:1157 (RAAC02040) and ref|ZP_01697399.1|, ref|YP_001124579.1|, ref|YP_146298.1|, ref|NP_691785.1|, and ref|ZP_01723229.1| (SEQ ID NOS:1159-1163 respectively), which all have the function assigned to SEQ ID NO:1157 in Table 1. Amino acids conserved among all sequences are indicted by a and generally conserved amino acids are indicated by a ":".

FIGS. 70A and 70B depict a sequence alignment between SEQ ID NO:1174 (RAAC02181) and ref|NP_391000.1|, ref|YP_080655.1|, ref|YP_173878.1|, ref|NP_242416.1|, and ref|YP_644452.1| (SEQ ID NOS:1176-1180 respectively), which all have the function assigned to SEQ ID NO:1174 in Table 1. Amino acids conserved among all sequences are indicted by a "*" and generally conserved amino acids are indicated by a ":".

FIG. 71 depicts a sequence alignment between SEQ ID NO:1191 (RAAC02222) and ref|YP_001487576.1|, ref|ZP_02211990.1|, ref|YP_001343716.1|, ref|NP_744947.1|, and ref|YP_633768.1| (SEQ ID NOS:1193-1197 respectively), which all have the function assigned to SEQ ID NO:1191 in Table 1. Amino acids conserved among all sequences are indicted by a "*" and generally conserved amino acids are indicated by a ":".

FIGS. 72A and 72B depict a sequence alignment between SEQ ID NO:1208 (RAAC02274) and ref|YP_146053.1|, ref|ZP_01869175.1|, ref|ZP_00989613.1|, ref|YP_001276414.1|, and ref|YP_001211401.11 (SEQ ID NOS: 1210-1214 respectively), which all have the function assigned to SEQ ID NO:1208 in Table 1. Amino acids conserved among all sequences are indicted by a "*" and generally conserved amino acids are indicated by a ":".

FIGS. 73A and 73B depict a sequence alignment between SEQ ID NO:1225 (RAAC02275) and ref|YP_146052.1|, ref|YP_001546552.1|, ref|YP_001636911.1|, ref|ZP_01514632.1|, and ref|YP_001274650.1| (SEQ ID NOS: 1227-1231 respectively), which all have the function assigned to SEQ ID NO:1225 in Table 1. Amino acids conserved among all sequences are indicted by a "*" and generally conserved amino acids are indicated by a ":".

FIG. 74 depicts a sequence alignment between SEQ ID NO:1242 (RAAC02426) and ref|NP_243521.1|, pdb|1W85|A, sp|P21873|ODPA_BACST, ref|YP_001421036.1|, and ref|YP_146911.1| (SEQ ID NOS:1244-1248 respectively), which all have the function assigned to SEQ ID NO:1242 in Table 1. Amino acids conserved among all sequences are indicted by a "*" and generally conserved amino acids are indicated by a ":".

FIG. 75 depicts a sequence alignment between SEQ ID NO:1259 (RAAC02427) and ref|ZP_01696304.1|, sp|P21874|ODPB_BACST, ref|YP_001125046.1|, pdb|1W85|B, and ref|YP_146912.1| (SEQ ID NOS:1261-1265 respectively), which all have the function assigned to SEQ ID NO:1259 Table 1. Amino acids conserved among all sequences are indicted by a "*" and generally conserved amino acids are indicated by a ":".

FIGS. 76A and 76B depict a sequence alignment between SEQ ID NO:1276 (RAAC02429) and ref|YP_001125048.1|, sp|P11959|DLDH1_BACST, ref|YP_146914.1|, ref|YP_001486601.1|, and pdb|1EBD|A (SEQ ID NOS:1278-1282 respectively), which all have the function assigned to SEQ ID NO:1276 in Table 1. Amino acids conserved among all sequences are indicted by a "*" and generally conserved amino acids are indicated by a ":".

FIGS. 77A and 77B depicts a sequence alignment between SEQ ID NO:1293 (RAAC00452) and pdb|2QE7|A, ref|YP_361340.1|, ref|YP_001127390.1|, ref|YP_149213.1|, and ref|YP_001356688.1| (SEQ ID NOS:1295-1299 respectively), which all have the function assigned to SEQ ID NO:1293 in Table 1. Amino acids conserved among all sequences are indicted by a "*" and generally conserved amino acids are indicated by a ":".

FIG. 78 depicts a sequence alignment between SEQ ID NO:1310 (RAAC02433) and ref|YP_001542913.1|, ref|YP_644829.1|, ref|YP_356005.1|, emb|CAO90974.1|, and ref|YP_001656571.1| (SEQ ID NOS:1312-1316 respectively), which all have the function assigned to SEQ ID NO:1310 in Table 1. Amino acids conserved among all sequences are indicted by a "*" and generally conserved amino acids are indicated by a ":".

FIGS. 79A and 79B depict a sequence alignment between SEQ ID NO:1327 (RAAC02438) and ref|YP_644476.1|, ref|ZP_02191297.1|, ref|ZP_01549387.1|, ref|ZP_01850519.1|, and ref|ZP_01015586.1| (SEQ ID NOS:1329-1333 respectively), which all have the function assigned to SEQ ID NO:1327 in Table 1. Amino acids conserved among all sequences are indicted by a "*" and generally conserved amino acids are indicated by a ":".

FIGS. 80A and 80B depict a sequence alignment between SEQ ID NO:1344 (RAAC02441) and ref|YP_147804.1|, ref|YP_001125954.1|, ref|YP_001125911.1|, ref|YP_147740.1|, and ref|NP_243178.1| (SEQ ID NOS:1346-1350 respectively), which all have the function assigned to SEQ ID NO:1344 in Table 1. Amino acids conserved among all sequences are indicted by a "*" and generally conserved amino acids are indicated by a ":".

FIG. 81 depicts a sequence alignment between SEQ ID NO:1361 (RAAC02442) and ref|YP_001125956.1|, ref|YP_147805.1|, ref|ZP_01169177.1|, ref|ZP_01695873.1|, and ref|NP_831941.1| (SEQ ID NOS:1363-1367 respectively), which all have the function assigned to SEQ ID NO:1361 in Table 1. Amino acids conserved among all sequences are indicted by a and generally conserved amino acids are indicated by a ":".

FIGS. 82A and 82B depict a sequence alignment between SEQ ID NO:1378 (RAAC02630) and ref|ZP_01695367.1|, ref|YP_723673.1|, ref|YP_686117.1|, ref|YP_001111391.1|, and ref|ZP_01623360.1| (SEQ ID NOS:1380-1384 respectively), which all have the function assigned to SEQ ID NO:1378 in Table 1. Amino acids conserved among all sequences are indicted by a "*" and generally conserved amino acids are indicated by a ":".

FIG. 83 depicts a sequence alignment between SEQ ID NO:1395 (RAAC02644) and ref|NP_782567.1|, sp|Q892U0|LDH_CLOTE, ref|YP_590559.1|, ref|ZP_01514103.1|, and ref|YP_009822.1| (SEQ ID NOS:1397-1401 respectively), which all have the function assigned to SEQ ID NO:1395 in Table 1. Amino acids conserved among all sequences are indicted by a "*" and generally conserved amino acids are indicated by a ":".

FIGS. 84A and 84B depict a sequence alignment between SEQ ID NO:1412 (RAAC02702) and ref|YP_001124710.1|, ref|YP_146529.1|, ref|NP_977551.1|, ref|YP_893868.1|, and ref|NP_843617.1| (SEQ ID NOS:1414-1418 respectively), which all have the function assigned to SEQ ID NO:1412 in Table 1. Amino acids conserved among all sequences are indicted by a and generally conserved amino acids are indicated by a ":".

FIGS. 85A and 85B depict a sequence alignment between SEQ ID NO:1429 (RAAC04058) and ref|ZP_02080303.1|, ref|YP_520543.1, ref|ZP_01966380.1|, ref|ZP_02039587.1|, and ref|ZP_02073747.11 (SEQ ID NOS:1431-1435 respectively), which all have the function assigned to SEQ ID NO:1429 in Table 1. Amino acids conserved among all sequences are indicted by a "*" and generally conserved amino acids are indicated by a ":".

FIGS. 86A and 86B depict a sequence alignment between SEQ ID NO:1446 (RAAC02843) and ref|YP_001125182.1|, ref|YP_147061.1|, ref|ZP_01171540.1|, ref|NP_692464.1, and ref|YP_001375719.1| (SEQ ID NOS:1448-1452 respectively), which all have the function assigned to SEQ ID NO:1446 in Table 1. Amino acids conserved among all sequences are indicted by a "*" and generally conserved amino acids are indicated by a ":".

FIG. 87 depicts a sequence alignment between SEQ ID NO:1463 (RAAC02844) and ref|YP_147062.1|, ref|YP_001125183.1|, ref|YP_079003.1|, ref|NP_243335.1|, and ref|ZP_01171539.1| (SEQ ID NOS:1465-1469 respectively), which all have the function assigned to SEQ ID NO:1463 in Table 1. Amino acids conserved among all sequences are indicted by a and generally conserved amino acids are indicated by a ":".

FIG. 88 depicts a sequence alignment between SEQ ID NO:1480 (RAAC00454) and ref|YP_001127392.1|, ref|YP_521149.1|, ref|YP_149215.1|, ref|YP_001488543.1|, and ref|YP_093437.1| (SEQ ID NOS:1482-1486 respectively), which all have the function assigned to SEQ ID NO:1480 in Table 1. Amino acids conserved among all sequences are indicted by a and generally conserved amino acids are indicated by a ":".

FIG. 89 depicts a sequence alignment between SEQ ID NO:1497 (RAAC02920) and ref|YP_001421255.1|, ref|NP_389559.1|, ref|YP_001125250.1|, ref|ZP_02169638.1|, and ref|YP_091490.1| (SEQ ID NOS:1499-1503 respectively), which all have the function assigned to SEQ ID NO:1497 in Table 1. Amino acids conserved among all sequences are indicted by a "*" and generally conserved amino acids are indicated by a ":".

FIGS. 90A and 90B depict a sequence alignment between SEQ ID NO:1514 (RAAC02924) and ref|YP_001375026.1|, ref|YP_175305.1|, ref|NP_844736.1|, ref|NP_691737.1|, and ref|NP_832053.1| (SEQ ID NOS:1516-1520 respectively), which all have the function assigned to SEQ ID NO:1514 in Table 1. Amino acids conserved among all sequences are indicted by a "*" and generally conserved amino acids are indicated by a ":".

FIGS. 91A and 91B depict a sequence alignment between SEQ ID NO:1531 (RAAC02926) and ref|YP_148646.1|, ref|ZP_01696063.1|, ref|ZP_01859600.1|, ref|YP_

001376529.1|, and ref|YP_038694.1| (SEQ ID NOS:1533-1537 respectively), which all have the function assigned to SEQ ID NO:1531 in Table 1. Amino acids conserved among all sequences are indicted by a "*" and generally conserved amino acids are indicated by a ":".

FIGS. 92A and 92B depict a sequence alignment between SEQ ID NO:1548 (RAAC02986) and ref|YP_146227.1|, ref|YP_001124476.1|, ref|ZP_01695767.1|, dbj|BAB39706.1|, and ref|ZP_01723231.1| (SEQ ID NOS: 1550-1554 respectively), which all have the function assigned to SEQ ID NO:1548 in Table 1. Amino acids conserved among all sequences are indicted by a "*" and generally conserved amino acids are indicated by a ":".

FIG. 93 depicts a sequence alignment between SEQ ID NO:1565 (RAAC03010) and ref|YP_001127080.1|, ref|YP_148885.1|, ref|YP_001374290.1|, ref|NP_693789.1|, and ref|YP_144223.1| (SEQ ID NOS:1567-1571 respectively), which all have the function assigned to SEQ ID NO:1565 in Table 1. Amino acids conserved among all sequences are indicted by a "*" and generally conserved amino acids are indicated by a ":".

DETAILED DESCRIPTION OF THE INVENTION

Embodiments of the invention include genes and associated proteins related to the metabolism of the thermoacidophile *Alicyclobacillus acidocaldarius*. Coding sequences for genes related to these processes were determined from sequence information generated from sequencing the genome of *Alicyclobacillus acidocaldarius*. These genes and proteins may represent targets and/or elements of transformation systems or vectors for metabolic engineering of *Alicyclobacillus acidocaldarius* or other organisms. Non-limiting examples of nucleotide sequences found within the genome of *Alicyclobacillus acidocaldarius*, and amino acids coded thereby, associated with metabolism are listed in Table 1. Metabolism proteins may be, without limitation, of the following classes: (S)-2-hydroxy-acid oxidases, [acyl-carrier-protein] S-malonyltransferases, 1,3-propanediol Dehydrogenases, 2-isopropylmalate Synthases, 3-hydroxybutyryl-CoA dehydratases, 3-isopropylmalate Dehydratases, 3-isopropylmalate Dehydrogenases, 3-oxoacid CoA-transferases, 8-amino-7-oxononanoate Synthases, Acetaldehyde dehydrogenases (acetylating), Acetate-CoA ligases, Acetolactate synthases, Acetyl-CoA C-acetyltransferases, Aconitate hydratases, Alcohol dehydrogenases, Alcohol dehydrogenases (NADP+), Aldehyde dehydrogenases, Aldehyde dehydrogenases (NAD+), ATP phosphoribosyltransferases, ATP synthase alpha chains, ATP synthase B chains, ATP synthase beta chains, ATP synthase C chains, ATP synthase epsilon chains, ATP synthase gamma chains, Biotin synthases, Branched-chain-amino-acid transaminases, Butyryl-CoA dehydrogenases, Citrate (Si)-synthases, Dethiobiotin synthases, Diaminopimelate decarboxylases, Diaminopimelate epimerases, Dihydrodipicolinate reductases, Dihydrodipicolinate synthases, Dihydrolipoyl dehydrogenases, Dihydroxy-acid dehydratases, Enoyl-CoA hydratases, FdhD proteins (fdsC), Formate dehydrogenases, Glycerate kinases, Glycine hydroxymethyltransferases, Isocitrate lyases, Lactaldehyde reductases, Lactate 2-monooxygenases, L-lactate dehydrogenases, Malate dehydrogenases, Malate dehydrogenases (acceptor), Malate dehydrogenases (oxaloacetate-decarboxylating), Malate synthases, Malonate-semialdehyde dehydrogenases (acetylating), Methylmalonate-semialdehyde dehydrogenases (acylating), N-acetyldiaminopimelate deacetylases, Oxoglutarate dehydrogenases (succinyl-transferring), Phosphoenolpyruvate carboxylases, Phosphoglycerate dehydrogenases, Phosphoribosylanthranilate isomerases, Pyruvate dehydrogenases (acetyl-transferring), Pyruvate phosphate dikinases, Succinate dehydrogenase cytochrome b558 subunits, Succinate dehydrogenase flavoprotein subunits, Succinate dehydrogenase iron-sulfur proteins, Succinate-CoA ligases (ADP-forming); and others.

Embodiments of the invention relate in part to the gene sequences and/or protein sequences comprising genes and/or proteins of *Alicyclobacillus acidocaldarius*. Genes and proteins included are those which play a role in metabolism. Intracellular enzyme activities may be thermophilic and/or acidophilic in nature and general examples of similar genes are described in the literature. Classes of genes, sequences, enzymes and factors include, but are not limited to, those listed in Table 1.

TABLE 1

*Alicyclobacillus acidocaldarius* genes related to metabolism

| Reference | Gene Sequence | Protein Sequence | Function |
|---|---|---|---|
| RAAC00079 | SEQ ID NO: 1 | SEQ ID NO: 2 | Acetate-CoA ligase |
| RAAC00455 | SEQ ID NO: 18 | SEQ ID NO: 19 | ATP synthase C chain |
| RAAC00461 | SEQ ID NO: 35 | SEQ ID NO: 36 | Glycine hydroxymethyltransferase |
| RAAC00481 | SEQ ID NO: 52 | SEQ ID NO: 53 | 3-hydroxybutyryl-CoA dehydratase |
| RAAC00529 | SEQ ID NO: 69 | SEQ ID NO: 70 | N-acetyldiaminopimelate deacetylase |
| RAAC00552 | SEQ ID NO: 86 | SEQ ID NO: 87 | Biotin synthase |
| RAAC00553 | SEQ ID NO: 103 | SEQ ID NO: 104 | Dethiobiotin synthase |
| RAAC00554 | SEQ ID NO: 120 | SEQ ID NO: 121 | 8-amino-7-oxononanoate Synthase |
| RAAC00632 | SEQ ID NO: 137 | SEQ ID NO: 138 | Branched-chain-amino-acid transaminase |
| RAAC00633 | SEQ ID NO: 154 | SEQ ID NO: 155 | Dihydroxy-acid dehydratase |
| RAAC00634 | SEQ ID NO: 171 | SEQ ID NO: 172 | Acetolactate synthase |
| RAAC00174 | SEQ ID NO: 188 | SEQ ID NO: 189 | [acyl-carrier-protein] S-malonyltransferase |

TABLE 1-continued

Alicyclobacillus acidocaldarius genes related to metabolism

| Reference Gene Sequence | Protein Sequence | Function |
| --- | --- | --- |
| RAAC00635 SEQ ID NO: 205 | SEQ ID NO: 206 | Acetolactate synthase |
| RAAC00637 SEQ ID NO: 222 | SEQ ID NO: 223 | 3-isopropylmalate Dehydrogenase |
| RAAC00638 SEQ ID NO: 239 | SEQ ID NO: 240 | 3-isopropylmalate Dehydratase |
| RAAC00639 SEQ ID NO: 256 | SEQ ID NO: 257 | 3-isopropylmalate Dehydratase |
| RAAC00642 SEQ ID NO: 273 | SEQ ID NO: 274 | Citrate (Si)-synthase |
| RAAC00727 SEQ ID NO: 290 | SEQ ID NO: 291 | Oxoglutarate dehydrogenase (succinyl-transferring) |
| RAAC00729 SEQ ID NO: 307 | SEQ ID NO: 308 | Malate dehydrogenase (acceptor) |
| RAAC00730 SEQ ID NO: 324 | SEQ ID NO: 325 | Malate dehydrogenase (oxaloacetate-decarboxylating) |
| RAAC00735 SEQ ID NO: 341 | SEQ ID NO: 342 | Phosphoenolpyruvate carboxylase |
| RAAC00812 SEQ ID NO: 358 | SEQ ID NO: 359 | 3-oxoacid CoA-transferase |
| RAAC00196 SEQ ID NO: 375 | SEQ ID NO: 376 | Malate dehydrogenase (oxaloacetate-decarboxylating) |
| RAAC00814 SEQ ID NO: 392 | SEQ ID NO: 393 | Acetyl-CoA C-acetyltransferase |
| RAAC00815 SEQ ID NO: 409 | SEQ ID NO: 410 | Acetate-CoA ligase |
| RAAC00816 SEQ ID NO: 426 | SEQ ID NO: 427 | Butyryl-CoA dehydrogenase |
| RAAC00822 SEQ ID NO: 443 | SEQ ID NO: 444 | 3-hydroxybutyryl-CoA dehydratase |
| RAAC00950 SEQ ID NO: 460 | SEQ ID NO: 461 | Formate dehydrogenase |
| RAAC00952 SEQ ID NO: 477 | SEQ ID NO: 478 | FdhD protein (fdsC) |
| RAAC00990 SEQ ID NO: 494 | SEQ ID NO: 495 | Dihydrodipicolinate reductase |
| RAAC01029 SEQ ID NO: 511 | SEQ ID NO: 512 | Acetaldehyde dehydrogenase (acetylating) |
| RAAC01041 SEQ ID NO: 528 | SEQ ID NO: 529 | Pyruvate, phosphate dikinase |
| RAAC01057 SEQ ID NO: 545 | SEQ ID NO: 546 | Enoyl-CoA hydratase |
| RAAC00352 SEQ ID NO: 562 | SEQ ID NO: 563 | Alcohol dehydrogenase (NADP+) |
| RAAC04321 SEQ ID NO: 579 | SEQ ID NO: 580 | Alcohol dehydrogenase |
| RAAC04349 SEQ ID NO: 596 | SEQ ID NO: 597 | Phosphoribosylanthranilate isomerase |
| RAAC01327 SEQ ID NO: 613 | SEQ ID NO: 614 | Aldehyde dehydrogenase (NAD+) |
| RAAC01351 SEQ ID NO: 630 | SEQ ID NO: 631 | (S)-2-hydroxy-acid oxidase |
| RAAC01352 SEQ ID NO: 647 | SEQ ID NO: 648 | (S)-2-hydroxy-acid oxidase |
| RAAC01354 SEQ ID NO: 664 | SEQ ID NO: 665 | Malate synthase |
| RAAC01360 SEQ ID NO: 681 | SEQ ID NO: 682 | (S)-2-hydroxy-acid oxidase |
| RAAC01408 SEQ ID NO: 698 | SEQ ID NO: 699 | Butyryl-CoA dehydrogenase |
| RAAC01425 SEQ ID NO: 715 | SEQ ID NO: 716 | Butyryl-CoA dehydrogenase |
| RAAC01517 SEQ ID NO: 732 | SEQ ID NO: 733 | Glycerate kinase |
| RAAC00449 SEQ ID NO: 749 | SEQ ID NO: 750 | ATP synthase epsilon chain |
| RAAC01555 SEQ ID NO: 766 | SEQ ID NO: 767 | Diaminopimelate decarboxylase |
| RAAC01575 SEQ ID NO: 783 | SEQ ID NO: 784 | Aldehyde dehydrogenase (NAD+) |
| RAAC01657 SEQ ID NO: 800 | SEQ ID NO: 801 | Pyruvate dehydrogenase (acetyl-transferring) |
| RAAC01658 SEQ ID NO: 817 | SEQ ID NO: 818 | Pyruvate dehydrogenase (acetyl-transferring) |

TABLE 1-continued

Alicyclobacillus acidocaldarius genes related to metabolism

| Reference | Gene Sequence | Protein Sequence | Function |
|---|---|---|---|
| RAAC01669 | SEQ ID NO: 834 | SEQ ID NO: 835 | Alcohol dehydrogenase |
| RAAC01678 | SEQ ID NO: 851 | SEQ ID NO: 852 | Formate dehydrogenase |
| RAAC01685 | SEQ ID NO: 868 | SEQ ID NO: 869 | 2-isopropylmalate Synthase |
| RAAC01745 | SEQ ID NO: 885 | SEQ ID NO: 886 | Pyruvate dehydrogenase (acetyl-transferring) |
| RAAC01746 | SEQ ID NO: 902 | SEQ ID NO: 903 | Pyruvate dehydrogenase (acetyl-transferring) |
| RAAC01748 | SEQ ID NO: 919 | SEQ ID NO: 920 | Lactate 2-monooxygenase |
| RAAC00450 | SEQ ID NO: 936 | SEQ ID NO: 937 | ATP synthase beta chain |
| RAAC01759 | SEQ ID NO: 953 | SEQ ID NO: 954 | Aconitate hydratase |
| RAAC01762 | SEQ ID NO: 970 | SEQ ID NO: 971 | Alcohol dehydrogenase |
| RAAC01763 | SEQ ID NO: 987 | SEQ ID NO: 988 | Alcohol dehydrogenase |
| RAAC01767 | SEQ ID NO: 1004 | SEQ ID NO: 1005 | ATP phosphoribosyltransferase |
| RAAC01797 | SEQ ID NO: 1021 | SEQ ID NO: 1022 | Butyryl-CoA dehydrogenase |
| RAAC01900 | SEQ ID NO: 1038 | SEQ ID NO: 1039 | Aldehyde dehydrogenase |
| RAAC01939 | SEQ ID NO: 1055 | SEQ ID NO: 1056 | Malate dehydrogenase |
| RAAC01996 | SEQ ID NO: 1072 | SEQ ID NO: 1073 | Diaminopimelate epimerase |
| RAAC02025 | SEQ ID NO: 1089 | SEQ ID NO: 1090 | Succinate dehydrogenase cytochrome b558 subunit |
| RAAC00451 | SEQ ID NO: 1106 | SEQ ID NO: 1107 | ATP synthase gamma chain |
| RAAC02026 | SEQ ID NO: 1123 | SEQ ID NO: 1124 | Succinate debydrogenase flavoprotein subunit |
| RAAC02027 | SEQ ID NO: 1140 | SEQ ID NO: 1141 | Succinate dehydrogenase iron-sulfur protein |
| RAAC02040 | SEQ ID NO: 1157 | SEQ ID NO: 1158 | Butyryl-CoA dehydrogenase |
| RAAC02181 | SEQ ID NO: 1174 | SEQ ID NO: 1175 | Lactaldehyde reductase |
| RAAC02222 | SEQ ID NO: 1191 | SEQ ID NO: 1192 | 1,3-propanediol Dehydrogenase |
| RAAC02274 | SEQ ID NO: 1208 | SEQ ID NO: 1209 | Alcohol dehydrogenase |
| RAAC02275 | SEQ ID NO: 1225 | SEQ ID NO: 1226 | Aldehyde dehydrogenase (NAD+) |
| RAAC02426 | SEQ ID NO: 1242 | SEQ ID NO: 1243 | Pyruvate dehydrogenase (acetyl-transferring) |
| RAAC02427 | SEQ ID NO: 1259 | SEQ ID NO: 1260 | Pyruvate dehydrogenase (acetyl-transferring) |
| RAAC02429 | SEQ ID NO: 1276 | SEQ ID NO: 1277 | Dihydrolipoyl dehydrogenase |
| RAAC00452 | SEQ ID NO: 1293 | SEQ ID NO: 1294 | ATP synthase alpha chain |
| RAAC02433 | SEQ ID NO: 1310 | SEQ ID NO: 1311 | 3-isopropylmalate Dehydrogenase |
| RAAC02438 | SEQ ID NO: 1327 | SEQ ID NO: 1328 | Acetate-CoA ligase |
| RAAC02441 | SEQ ID NO: 1344 | SEQ ID NO: 1345 | Malonate-semialdehyde dehydrogenase (acetylating) |
| RAAC02442 | SEQ ID NO: 1361 | SEQ ID NO: 1362 | 1,3-propanediol Dehydrogenase |
| RAAC02630 | SEQ ID NO: 1378 | SEQ ID NO: 1379 | Phosphoglycerate dehydrogenase |
| RAAC02644 | SEQ ID NO: 1395 | SEQ ID NO: 1396 | L-lactate dehydrogenase |
| RAAC02702 | SEQ ID NO: 1412 | SEQ ID NO: 1413 | Isocitrate lyase |
| RAAC04058 | SEQ ID NO: 1429 | SEQ ID NO: 1430 | 2-isopropylmalate Synthase |
| RAAC02843 | SEQ ID NO: 1446 | SEQ ID NO: 1447 | Succinate-CoA ligase (ADP-forming) |

TABLE 1-continued

Alicyclobacillus acidocaldarius genes related to metabolism

| Reference | Gene Sequence | Protein Sequence | Function |
|---|---|---|---|
| RAAC02844 | SEQ ID NO: 1463 | SEQ ID NO: 1464 | Succinate-CoA ligase (ADP-forming) |
| RAAC00454 | SEQ ID NO: 1480 | SEQ ID NO: 1481 | ATP synthase B chain |
| RAAC02920 | SEQ ID NO: 1497 | SEQ ID NO: 1498 | Dihydrodipicolinate synthase |
| RAAC02924 | SEQ ID NO: 1514 | SEQ ID NO: 1515 | Methylmalonate-semialdehyde dehydrogenase (acylating) |
| RAAC02926 | SEQ ID NO: 1531 | SEQ ID NO: 1532 | Acetate-CoA ligase |
| RAAC02986 | SEQ ID NO: 1548 | SEQ ID NO: 1549 | Aldehyde dehydrogenase (NAD+) |
| RAAC03010 | SEQ ID NO: 1565 | SEQ ID NO: 1566 | Dihydrodipicolinate synthase |

The present invention relates to nucleotides sequences comprising isolated and/or purified nucleotide sequences of the genome of *Alicyclobacillus acidocaldarius* selected from the sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 or one of their fragments.

The present invention likewise relates to isolated and/or purified nucleotide sequences, characterized in that they comprise at least one of: a) a nucleotide sequence of at least one of the sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 or one of their fragments; b) a nucleotide sequence homologous to a nucleotide sequence such as defined in a); c) a nucleotide sequence complementary to a nucleotide sequence such as defined in a) or b), and a nucleotide sequence of their corresponding RNA; d) a nucleotide sequence capable of hybridizing under stringent conditions with a sequence such as defined in a), b) or c); e) a nucleotide sequence comprising a sequence such as defined in a), b), c) or d); and f) a nucleotide sequence modified by a nucleotide sequence such as defined in a), b), c), d) or e).

Nucleotide, polynucleotide, or nucleic acid sequence will be understood according to the present invention as meaning both a double-stranded or single-stranded DNA in the monomeric and dimeric (so-called in tandem) forms and the transcription products of said DNAs.

Aspects of the invention relate to nucleotide sequences in which it has been possible to isolate, purify or partially purify, starting from separation methods such as, for example, ion-exchange chromatography, by exclusion based on molecular size, or by affinity, or alternatively, fractionation techniques based on solubility in different solvents, or starting from methods of genetic engineering such as amplification, cloning, and subcloning, it being possible for the sequences of the invention to be carried by vectors.

Isolated and/or purified nucleotide sequence fragment according to the invention will be understood as designating any nucleotide fragment of the genome of *Alicyclobacillus acidocaldarius*, and may include, by way of non-limiting example, a length of at least 8, 12, 20, 25, 50, 75, 100, 200, 300, 400, 500, 1000, or more, consecutive nucleotides of the sequence from which it originates.

Specific fragment of an isolated and/or purified nucleotide sequence according to the invention will be understood as designating any nucleotide fragment of the genome of *Alicyclobacillus acidocaldarius*, having, after alignment and comparison with the corresponding fragments of genomic sequences of *Alicyclobacillus acidocaldarius*, at least one nucleotide or base of different nature.

Homologous isolated and/or purified nucleotide sequence in the sense of the present invention is understood as meaning an isolated and/or purified nucleotide sequence having at least a percentage identity with the bases of a nucleotide sequence according to the invention of at least about 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7%, this percentage being purely statistical and it being possible to distribute the differences between the two nucleotide sequences at random and over the whole of their length.

Specific homologous nucleotide sequence in the sense of the present invention is understood as meaning a homologous nucleotide sequence having at least one nucleotide sequence of a specific fragment, such as defined above. Said "specific" homologous sequences can comprise, for example, the sequences corresponding to the genomic sequence or to the sequences of its fragments representative of variants of the genome of *Alicyclobacillus acidocaldarius*. These specific homologous sequences can thus correspond to variations linked to mutations within strains of *Alicyclobacillus acidocaldarius*, and especially correspond to truncations, substitutions, deletions and/or additions of at least one nucleotide. Said homologous sequences can likewise correspond to variations linked to the degeneracy of the genetic code.

The term "degree or percentage of sequence homology" refers to "degree or percentage of sequence identity between two sequences after optimal alignment" as defined in the present application.

Two amino-acids or nucleotidic sequences are said to be "identical" if the sequence of amino-acids or nucleotidic residues, in the two sequences is the same when aligned for maximum correspondence as described below. Sequence comparisons between two (or more) peptides or polynucleotides are typically performed by comparing sequences of two optimally aligned sequences over a segment or "comparison window" to identify and compare local regions of sequence similarity. Optimal alignment of sequences for comparison may be conducted by the local homology algorithm of Smith and Waterman, *Ad. App. Math* 2:482 (1981), by the homology alignment algorithm of Neddleman and Wunsch, *J. Mol. Biol.* 48:443 (1970), by the search for similarity method of Pearson and Lipman, *Proc. Natl. Acad. Sci.* (U.S.A.) 85:2444 (1988), by computerized implementation of these algorithms (GAP, BESTFIT, FASTA, and TFASTA in the Wisconsin Genetics Software Package, Genetics Computer Group (GCG), 575 Science Dr., Madison, Wis.), or by visual inspection.

"Percentage of sequence identity" (or degree of identity) is determined by comparing two optimally aligned sequences over a comparison window, where the portion of the peptide or polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical amino-acid residue or nucleic acid base occurs in both sequences to yield the number of matched positions, dividing the number of matched positions by the total number of positions in the window of comparison and multiplying the result by 100 to yield the percentage of sequence identity.

The definition of sequence identity given above is the definition that would be used by one of skill in the art. The definition by itself does not need the help of any algorithm, said algorithms being helpful only to achieve the optimal alignments of sequences, rather than the calculation of sequence identity.

From the definition given above, it follows that there is a well defined and only one value for the sequence identity between two compared sequences which value corresponds to the value obtained for the best or optimal alignment.

In the BLAST N or BLAST P "BLAST 2 sequence, " software which is available at the web site ncbi.nlm.nih.gov/gorf/bl2.html, and habitually used by the inventors and in general by the skilled person for comparing and determining the identity between two sequences, gap cost which depends on the sequence length to be compared is directly selected by the software (i.e., 11.2 for substitution matrix BLOSUM-62 for length>85).

Complementary nucleotide sequence of a sequence of the invention is understood as meaning any DNA whose nucleotides are complementary to those of the sequence of the invention, and whose orientation is reversed (antisense sequence).

Hybridization under conditions of stringency with a nucleotide sequence according to the invention is understood as meaning hybridization under conditions of temperature and ionic strength chosen in such a way that they allow the maintenance of the hybridization between two fragments of complementary DNA.

By way of illustration, conditions of great stringency of the hybridization step with the aim of defining the nucleotide fragments described above are advantageously the following.

The hybridization is carried out at a preferential temperature of 65° C. in the presence of SSC buffer, 1×SSC corresponding to 0.15 M NaCl and 0.05 M Na citrate. The washing steps, for example, can be the following: 2×SSC, at ambient temperature followed by two washes with 2×SSC, 0.5% SDS at 65° C.; 2×0.5×SSC, 0.5% SDS; at 65° C. for 10 minutes each.

The conditions of intermediate stringency, using, for example, a temperature of 42° C. in the presence of a 2×SSC buffer, or of less stringency, for example, a temperature of 37° C. in the presence of a 2×SSC buffer, respectively, require a globally less significant complementarity for the hybridization between the two sequences.

The stringent hybridization conditions described above for a polynucleotide with a size of approximately 350 bases will be adapted by the person skilled in the art for oligonucleotides of greater or smaller size, according to the teachings of Sambrook et al., 1989.

Among the isolated and/or purified nucleotide sequences according to the invention, are those that can be used as a primer or probe in methods allowing the homologous sequences according to the invention to be obtained, these methods, such as the polymerase chain reaction (PCR), nucleic acid cloning, and sequencing, being well known to a person skilled in the art.

Among the isolated and/or purified nucleotide sequences according to the invention, those are again preferred that can be used as a primer or probe in methods allowing the presence of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566, one of their fragments, or one of their variants such as defined below to be diagnosed.

The nucleotide sequence fragments according to the invention can be obtained, for example, by specific amplification, such as PCR, or after digestion with appropriate restriction enzymes of nucleotide sequences according to the invention, these methods in particular being described in the work of Sambrook et al., 1989. Such representative fragments can likewise be obtained by chemical synthesis according to methods well known to persons of ordinary skill in the art.

Modified nucleotide sequence will be understood as meaning any nucleotide sequence obtained by mutagenesis according to techniques well known to a person skilled in the art, and containing modifications with respect to the normal sequences according to the invention, for example, mutations in the regulatory and/or promoter sequences of polypeptide expression, especially leading to a modification of the rate of expression of said polypeptide or to a modulation of the replicative cycle.

Modified nucleotide sequence will likewise be understood as meaning any nucleotide sequence coding for a modified polypeptide, such as defined below.

The present invention relates to nucleotide sequence comprising isolated and/or purified nucleotide sequences of *Alicyclobacillus acidocaldarius*, characterized in that they are selected from the sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 or one of their fragments.

Embodiments of the invention likewise relate to isolated and/or purified nucleotide sequences characterized in that they comprise a nucleotide sequence selected from: a) at least one of a nucleotide sequence of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 or one of their fragments or one of their fragments; b) a nucleotide sequence of a specific fragment of a sequence such as defined in a); c) a homologous nucleotide sequence having at least 80% identity with a sequence such as defined in a) or b); d) a complementary nucleotide sequence or sequence of RNA corresponding to a sequence such as defined in a), b) or c); and e) a nucleotide sequence modified by a sequence such as defined in a), b), c) or d).

Among the isolated and/or purified nucleotide sequences according to the invention are the nucleotide sequences of SEQ ID NOS:13-17, 30-34, 47-51, 64-68, 81-85, 98-102, 115-119, 132-136, 149-153, 166-170, 183-187, 200-204, 217-221, 234-238, 251-255, 268-272, 285-289, 302-306, 319-323, 336-340, 353-357, 370-374, 387-391, 404-408, 421-425, 438-442, 455-459, 472-476, 489-493, 506-510, 523-527, 540-544, 557-561, 574-578, 591-595, 608-612, 625-629, 642-646, 659-663, 676-680, 693-697, 710-714, 727-731, 744-748, 761-765, 778-782, 795-799, 812-816, 829-833, 846-850, 863-867, 880-884, 897-901, 914-918, 931-935, 948-952, 965-969, 982-986, 999-1003, 1016-1020, 1033-1037, 1050-1054, 1067-1071, 1084-1088, 1101-1105, 1118-1122, 1135-1139, 1152-1156, 1169-1173, 1186-1190, 1203-1207, 1220-1224, 1237-1241, 1254-1258, 1271-1275, 1288-1292, 1305-1309, 1322-1326, 1339-1343, 1356-1360, 1373-1377, 1390-1394, 1407-1411, 1424-1428, 1441-1445, 1458-1462, 1475-1479, 1492-1496, 1509-1513, 1526-1530, 1543-1547, 1560-1564, and 1577-1581, or fragments thereof and any isolated and/or purified nucleotide sequences which have a homology of at least 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7% identity with the at least one of the sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 or fragments thereof. Such homologous sequences can comprise, for example, the sequences of corresponding to the genomic sequences of *Alicyclobacillus acidocaldarius*. In the same manner, these specific homologous sequences can correspond to variations linked to mutations within strains of *Alicyclobacillus acidocaldarius* and especially correspond to truncations, substitutions, deletions and/or additions of at least one nucleotide. As will be apparent to one of ordinary skill in the art, such homologues are easily created and identified using conventional techniques and publicly available computer programs such as BLAST. Accordingly, each homologue referenced above should be considered as set forth herein and fully described.

Embodiments of the invention comprise the isolated and/or purified polypeptides coded for by a nucleotide sequence according to the invention, or fragments thereof, whose sequence is represented by a fragment. Amino acid sequences corresponding to the isolated and/or purified polypeptides which can be coded for according to one of the three possible reading frames of at least one of the sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566.

Embodiments of the invention likewise relate to the isolated and/or purified polypeptides, characterized in that they comprise a polypeptide selected from at least one of the amino acid sequences of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 or one of their fragments.

Among the isolated and/or purified polypeptides, according to embodiments of the invention, are the isolated and/or purified polypeptides of amino acid sequence SEQ ID NOS: 8-12, 25-29, 4246, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, 773-777, 790-794, 807-811, 824-828, 841-845, 858-862, 875-879, 892-896, 909-913, 926-930, 943-947, 960-964, 977-981, 994-998, 1011-1015, 1028-1032, 1045-1049, 1062-1066, 1079-1083, 1096-1100, 1113-1117, 1130-1134, 1147-1151, 1164-1168, 1181-1185, 1198-1202, 1215-1219, 1232-1236, 1249-1253, 1266-1270, 1283-1287, 1300-1304, 1317-1321, 1334-1338, 1351-1355, 1368-1372, 1385-1389, 1402-1406, 1419-1423, 1436-1440, 1453-1457, 1470-1474, 1487-1491, 1504-1508, 1521-1525, 1538-1542, 1555-1559, and 1572-1576, or fragments thereof or any other isolated and/or purified polypeptides which have a homology of at least 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7% identity with at least one of the sequences of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 or fragments thereof. As will be apparent to one of ordinary skill in the art, such homologues are easily created and identified using conventional techniques and publicly available computer programs such as BLAST. Accordingly, each homologue referenced above should be considered as set forth herein and fully described.

Embodiments of the invention also relate to the polypeptides, characterized in that they comprise a polypeptide selected from: a) a specific fragment of at least 5 amino acids of a polypeptide of an amino acid sequence according to the invention; b) a polypeptide homologous to a polypeptide such as defined in a); c) a specific biologically active fragment of a polypeptide such as defined in a) or b); and d) a polypeptide modified by a polypeptide such as defined in a), b) or c).

In the present description, the terms polypeptide, peptide and protein are interchangeable.

In embodiments of the invention, the isolated and/or purified polypeptides according to the invention may be glycosylated, pegylated, and/or otherwise post-translationally modified. In further embodiments, glycosylation, pegylation, and/or other post-translational modifications may occur in vivo or in vitro and/or may be performed using chemical techniques. In additional embodiments, any glycosylation, pegylation and/or other post-translational modifications may be N-linked or O-linked.

In embodiments of the invention any one of the isolated and/or purified polypeptides according to the invention may be enzymatically or functionally active at temperatures at or above about 25, 30, 35, 40, 45, 50, 55, 60, 65, 70, 75, 80, 85, 90, and/or 95 degrees Celsius and/or may be enzymatically or functionally active at a pH at, below, and/or above 8, 7, 6, 5, 4, 3, 2, 1, and/or 0. In further embodiments of the invention, glycosylation, pegylation, and/or other post-translational modification may be required for the isolated and/or purified polypeptides according to the invention to be enzymatically or functionally active at a pH at or below 8, 7, 6, 5, 4, 3, 2, 1, and/or 0 or at temperatures at or above about 25, 30, 35, 40, 45, 50, 55, 60, 65, 70, 75, 80, 85, 90, and/or 95 degrees Celsius.

Aspects of the invention relate to polypeptides that are isolated or obtained by purification from natural sources, or else obtained by genetic recombination, or alternatively by chemical synthesis and that they may thus contain unnatural amino acids, as will be described below.

A "polypeptide fragment" according to the embodiments of the invention is understood as designating a polypeptide containing at least 5 consecutive amino acids, preferably 10 consecutive amino acids or 15 consecutive amino acids.

In the present invention, a specific polypeptide fragment is understood as designating the consecutive polypeptide fragment coded for by a specific fragment nucleotide sequence according to the invention.

"Homologous polypeptide" will be understood as designating the polypeptides having, with respect to the natural polypeptide, certain modifications such as, in particular, a deletion, addition, or substitution of at least one amino acid, a truncation, a prolongation, a chimeric fusion, and/or a mutation. Among the homologous polypeptides, those are preferred whose amino acid sequence has at least 80% or 90%, homology with the sequences of amino acids of polypeptides according to the invention.

"Specific homologous polypeptide" will be understood as designating the homologous polypeptides such as defined above and having a specific fragment of polypeptide according to the invention.

In the case of a substitution, one or more consecutive or nonconsecutive amino acids are replaced by "equivalent" amino acids. The expression "equivalent" amino acid is directed here at designating any amino acids capable of being substituted by one of the amino acids of the base structure without, however, essentially modifying the biological activities of the corresponding peptides and such that they will be defined by the following. As will be apparent to one of ordinary skill in the art, such substitutions are easily created and identified using standard molecular biology techniques and publicly available computer programs such as BLAST. Accordingly, each substitution referenced above should be considered as set forth herein and fully described. Examples of such substitutions in the amino acid sequences of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 may include those isolated and/or purified polypeptides of amino acid sequence SEQ ID NOS:8-12, 25-29, 42-46, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, 773-777, 790-794, 807-811, 824-828, 841-845, 858-862, 875-879, 892-896, 909-913, 926-930, 943-947, 960-964, 977-981, 994-998, 1011-1015, 1028-1032, 1045-1049, 1062-1066, 1079-1083, 1096-1100, 1113-1117, 1130-1134, 1147-1151, 1164-1168, 1181-1185, 1198-1202, 1215-1219, 1232-1236, 1249-1253, 1266-1270, 1283-1287, 1300-1304, 1317-1321, 1334-1338, 1351-1355, 1368-1372, 1385-1389, 1402-1406, 1419-1423, 1436-1440, 1453-1457, 1470-1474, 1487-1491, 1504-1508, 1521-1525, 1538-1542, 1555-1559, and 1572-1576. These equivalent amino acids may be determined either by depending on their structural homology with the amino acids which they substitute, or on results of comparative tests of biological activity between the different polypeptides, which are capable of being carried out.

By way of non-limiting example, the possibilities of substitutions capable of being carried out without resulting in an extensive modification of the biological activity of the corresponding modified polypeptides will be mentioned, the replacement, for example, of leucine by valine or isoleucine, of aspartic acid by glutamic acid, of glutamine by asparagine, of arginine by lysine, etc., the reverse substitutions naturally being envisageable under the same conditions.

In a further embodiment, substitutions are limited to substitutions in amino acids not conserved among other proteins which have similar identified enzymatic activity. For example, one of ordinary skill in the art may align proteins of the same function in similar organisms and determine which amino acids are generally conserved among proteins of that function. One example of a program that may be used to generate such alignments is available at the web site charite.de/bioinf/strap/ in conjunction with the databases provided by the NCBI. Examples of such polypeptides may include, but are not limited to, those found in amino acid sequence SEQ ID NOS:8-12, 25-29, 42-46, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, 773-777, 790-794, 807-811, 824-828, 841-845, 858-862, 875-879, 892-896, 909-913, 926-930, 943-947, 960-964, 977-981, 994-998, 1011-1015, 1028-1032, 1045-1049, 1062-1066, 1079-1083, 1096-1100, 1113-

1117, 1130-1134, 1147-1151, 1164-1168, 1181-1185, 1198-1202, 1215-1219, 1232-1236, 1249-1253, 1266-1270, 1283-1287, 1300-1304, 1317-1321, 1334-1338, 1351-1355, 1368-1372, 1385-1389, 1402-1406, 1419-1423, 1436-1440, 1453-1457, 1470-1474, 1487-1491, 1504-1508, 1521-1525, 1538-1542, 1555-1559, and 1572-1576.

Thus, according to one embodiment of the invention, substitutions or mutations may be made at positions that are generally conserved among proteins of that function. In a further embodiment, nucleic acid sequences may be mutated or substituted such that the amino acid they code for is unchanged (degenerate substitutions and/or mutations) and/or mutated or substituted such that any resulting amino acid substitutions or mutations are made at positions that are generally conserved among proteins of that function. Examples of such nucleic acid sequences may include, but are not limited to, those found in are the nucleotide sequences of SEQ ID NOS:13-17, 30-34, 47-51, 64-68, 81-85, 98-102, 115-119, 132-136, 149-153, 166-170, 183-187, 200-204, 217-221, 234-238, 251-255, 268-272, 285-289, 302-306, 319-323, 336-340, 353-357, 370-374, 387-391, 404-408, 421-425, 438-442, 455-459, 472-476, 489-493, 506-510, 523-527, 540-544, 557-561, 574-578, 591-595, 608-612, 625-629, 642-646, 659-663, 676-680, 693-697, 710-714, 727-731, 744-748, 761-765, 778-782, 795-799, 812-816, 829-833, 846-850, 863-867, 880-884, 897-901, 914-918, 931-935, 948-952, 965-969, 982-986, 999-1003, 1016-1020, 1033-1037, 1050-1054, 1067-1071, 1084-1088, 1101-1105, 1118-1122, 1135-1139, 1152-1156, 1169-1173, 1186-1190, 1203-1207, 1220-1224, 1237-1241, 1254-1258, 1271-1275, 1288-1292, 1305-1309, 1322-1326, 1339-1343, 1356-1360, 1373-1377, 1390-1394, 1407-1411, 1424-1428, 1441-1445, 1458-1462, 1475-1479, 1492-1496, 1509-1513, 1526-1530, 1543-1547, 1560-1564, 1577-1581 or fragments thereof.

The specific homologous polypeptides likewise correspond to polypeptides coded for by the specific homologous nucleotide sequences such as defined above and thus comprise in the present definition the polypeptides, which are mutated or correspond to variants that can exist in *Alicyclobacillus acidocaldarius*, and which especially correspond to truncations, substitutions, deletions, and/or additions of at least one amino acid residue.

"Specific biologically active fragment of a polypeptide" according to an embodiment of the invention will be understood in particular as designating a specific polypeptide fragment, such as defined above, having at least one of the characteristics of polypeptides according to the invention. In certain embodiments the peptide is capable of behaving as at least one of the types of proteins outlined in Table 1.

The polypeptide fragments according to embodiments of the invention can correspond to isolated or purified fragments naturally present in *Alicyclobacillus acidocaldarius* or correspond to fragments that can be obtained by cleavage of said polypeptide by a proteolytic enzyme, such as trypsin or chymotrypsin or collagenase, or by a chemical reagent, such as cyanogen bromide (CNBr). Such polypeptide fragments can likewise just as easily be prepared by chemical synthesis, from hosts transformed by an expression vector according to the invention containing a nucleic acid allowing the expression of said fragments, placed under the control of appropriate regulation and/or expression elements.

"Modified polypeptide" of a polypeptide according to an embodiment of the invention is understood as designating a polypeptide obtained by genetic recombination or by chemical synthesis as will be described below, having at least one modification with respect to the normal sequence. These modifications may or may not be able to bear on amino acids at the origin of specificity, and/or of activity, or at the origin of the structural conformation, localization, and of the capacity of membrane insertion of the polypeptide according to the invention. It will thus be possible to create polypeptides of equivalent, increased, or decreased activity, and of equivalent, narrower, or wider specificity. Among the modified polypeptides, it is necessary to mention the polypeptides in which up to 5 or more amino acids can be modified, truncated at the N- or C-terminal end, or even deleted or added.

The methods allowing said modulations on eukaryotic or prokaryotic cells to be demonstrated are well known to a person of ordinary skill in the art. It is likewise well understood that it will be possible to use the nucleotide sequences coding for said modified polypeptides for said modulations, for example, through vectors according to the invention and described below.

The preceding modified polypeptides can be obtained by using combinatorial chemistry, in which it is possible to systematically vary parts of the polypeptide before testing them on models, cell cultures or microorganisms, for example, to select the compounds that are most active or have the properties sought.

Chemical synthesis likewise has the advantage of being able to use nonnatural amino acids, or nonpeptide bonds.

Thus, in order to improve the duration of life of the polypeptides according to the invention, it may be of interest to use nonnatural amino acids, for example, in D form, or else amino acid analogs, especially sulfur-containing forms, for example.

Finally, it will be possible to integrate the structure of the polypeptides according to the invention, its specific or modified homologous forms, into chemical structures of polypeptide type or others. Thus, it may be of interest to provide at the N- and C-terminal ends molecules not recognized by proteases.

The nucleotide sequences coding for a polypeptide according to the invention are likewise part of the invention.

The invention likewise relates to nucleotide sequences utilizable as a primer or probe, characterized in that said sequences are selected from the nucleotide sequences according to the invention.

It is well understood that the present invention, in various embodiments, likewise relates to specific polypeptides of *Alicyclobacillus acidocaldarius*, coded for by nucleotide sequences, capable of being obtained by purification from natural polypeptides, by genetic recombination or by chemical synthesis by procedures well known to a person skilled in the art and such as described in particular below. In the same manner, the labeled or unlabeled mono- or polyclonal antibodies directed against said specific polypeptides coded for by said nucleotide sequences are also encompassed by the invention.

Embodiments of the invention additionally relate to the use of a nucleotide sequence according to the invention as a primer or probe for the detection and/or the amplification of nucleic acid sequences.

The nucleotide sequences according to embodiments of the invention can thus be used to amplify nucleotide sequences, especially by the PCR technique (polymerase chain reaction) (Erlich, 1989; Innis et al., 1990; Rolfs et al., 1991; and White et al., 1997).

These oligodeoxyribonucleotide or oligoribonucleotide primers advantageously have a length of at least 8 nucleotides, preferably of at least 12 nucleotides, and even more preferentially of at least 20 nucleotides.

Other amplification techniques of the target nucleic acid can be advantageously employed as alternatives to PCR.

The nucleotide sequences of the invention, in particular the primers according to the invention, can likewise be employed in other procedures of amplification of a target nucleic acid, such as: the TAS technique (Transcription-based Amplification System), described by Kwoh et al. in 1989; the 3SR technique (Self-Sustained Sequence Replication), described by Guatelli et al. in 1990; the NASBA technique (Nucleic Acid Sequence Based Amplification), described by Kievitis et al. in 1991; the SDA technique (Strand Displacement Amplification) (Walker et al., 1992); and the TMA technique (Transcription Mediated Amplification).

The polynucleotides of the invention can also be employed in techniques of amplification or of modification of the nucleic acid serving as a probe, such as: the LCR technique (Ligase Chain Reaction), described by Landegren et al. in 1988 and improved by Barany et al. in 1991, which employs a thermostable ligase; the RCR technique (Repair Chain Reaction), described by Segev in 1992; the CPR technique (Cycling Probe Reaction), described by Duck et al. in 1990; the amplification technique with Q-beta replicase, described by Miele et al. in 1983 and especially improved by Chu et al. in 1986, Lizardi et al. in 1988, then by Burg et al., as well as by Stone et al. in 1996.

In the case where the target polynucleotide to be detected is possibly an RNA, for example, an mRNA, it will be possible to use, prior to the employment of an amplification reaction with the aid of at least one primer according to the invention or to the employment of a detection procedure with the aid of at least one probe of the invention, an enzyme of reverse transcriptase type in order to obtain a cDNA from the RNA contained in the biological sample. The cDNA obtained will thus serve as a target for the primer(s) or the probe(s) employed in the amplification or detection procedure according to the invention.

The detection probe will be chosen in such a manner that it hybridizes with the target sequence or the amplicon generated from the target sequence. By way of sequence, such a probe will advantageously have a sequence of at least 12 nucleotides, in particular of at least 20 nucleotides, and preferably of at least 100 nucleotides.

Embodiments of the invention also comprise the nucleotide sequences utilizable as a probe or primer according to the invention, characterized in that they are labeled with a radioactive compound or with a nonradioactive compound.

The unlabeled nucleotide sequences can be used directly as probes or primers, although the sequences are generally labeled with a radioactive isotope ($^{32}P$, $^{35}S$, $^{3}H$, $^{125}I$) or with a nonradioactive molecule (biotin, acetylaminofluorene, digoxigenin, 5-bromodeoxyuridine, fluorescein) to obtain probes which are utilizable for numerous applications.

Examples of nonradioactive labeling of nucleotide sequences are described, for example, in French Patent No. 7810975 or by Urdea et al. or by Sanchez-Pescador et al. in 1988.

In the latter case, it will also be possible to use one of the labeling methods described in patents FR-2 422 956 and FR-2 518 755.

The hybridization technique can be carried out in various manners (Matthews et al., 1988). The most general method consists in immobilizing the nucleic acid extract of cells on a support (such as nitrocellulose, nylon, polystyrene) and in incubating, under well-defined conditions, the immobilized target nucleic acid with the probe. After hybridization, the excess of probe is eliminated and the hybrid molecules formed are detected by the appropriate method (measurement of the radioactivity, of the fluorescence or of the enzymatic activity linked to the probe).

The invention, in various embodiments, likewise comprises the nucleotide sequences according to the invention, characterized in that they are immobilized on a support, covalently or noncovalently.

According to another advantageous mode of employing nucleotide sequences according to the invention, the latter can be used immobilized on a support and can thus serve to capture, by specific hybridization, the target nucleic acid obtained from the biological sample to be tested. If necessary, the solid support is separated from the sample and the hybridization complex formed between said capture probe and the target nucleic acid is then detected with the aid of a second probe, a so-called detection probe, labeled with an easily detectable element.

Another aspect of the present invention is a vector for the cloning and/or expression of a sequence, characterized in that it contains a nucleotide sequence according to the invention.

The vectors, according to the invention, characterized in that they contain the elements allowing the integration, expression and/or the secretion of said nucleotide sequences in a determined host cell, are likewise part of the invention.

The vector may then contain a promoter, signals of initiation and termination of translation, as well as appropriate regions of regulation of transcription. It may be able to be maintained stably in the host cell and can optionally have particular signals specifying the secretion of the translated protein. These different elements may be chosen as a function of the host cell used. To this end, the nucleotide sequences according to the invention may be inserted into autonomous replication vectors within the chosen host, or integrated vectors of the chosen host.

Such vectors will be prepared according to the methods currently used by a person skilled in the art, and it will be possible to introduce the clones resulting therefrom into an appropriate host by standard methods, such as, for example, lipofection, electroporation, and thermal shock.

The vectors according to the invention are, for example, vectors of plasmid or viral origin. One example of a vector for the expression of polypeptides of the invention is Baculovirus.

These vectors are useful for transforming host cells in order to clone or to express the nucleotide sequences of the invention.

The invention likewise comprises the host cells transformed by a vector according to the invention.

These cells can be obtained by the introduction into host cells of a nucleotide sequence inserted into a vector such as defined above, then the culturing of said cells under conditions allowing the replication and/or expression of the transfected nucleotide sequence.

The host cell can be selected from prokaryotic or eukaryotic systems, such as, for example, bacterial cells (Olins and Lee, 1993), but likewise yeast cells (Buckholz, 1993), as well as plants cells, such as *Arabidopsis* sp., and animal cells, in particular the cultures of mammalian cells (Edwards and Aruffo, 1993), for example, Chinese hamster ovary (CHO) cells, but likewise the cells of insects in which it is possible to use procedures employing baculoviruses, for example, Sf9 insect cells (Luckow, 1993).

Embodiments of the invention likewise relate to organisms comprising one of said transformed cells according to the invention.

The obtainment of transgenic organisms, according to the invention, of expressing one or more of the genes of *Alicyclobacillus acidocaldarius* or part of the genes may be carried out in, for example, rats, mice, or rabbits according to methods well known to a person skilled in the art, such as by viral or nonviral transfections. It will be possible to obtain the transgenic organisms expressing one or more of said genes by transfection of multiple copies of said genes under the control of a strong promoter of ubiquitous nature, or selective for one type of tissue. It will likewise be possible to obtain the transgenic organisms by homologous recombination in embryonic cell strains, transfer of these cell strains to embryos, selection of the affected chimeras at the level of the reproductive lines, and growth of said chimeras.

The transformed cells, as well as the transgenic organisms according to the Invention, are utilizable in procedures for preparation of recombinant polypeptides.

It is today possible to produce recombinant polypeptides in relatively large quantity by genetic engineering using the cells transformed by expression vectors according to the invention or using transgenic organisms according to the invention.

The procedures for preparation of a polypeptide of the invention in recombinant form, characterized in that they employ a vector and/or a cell transformed by a vector according to the invention and/or a transgenic organism comprising one of said transformed cells according to the invention are themselves comprised in the present invention.

As used herein, "transformation" and "transformed" relate to the introduction of nucleic acids into a cell, whether prokaryotic or eukaryotic. Further, "transformation" and "transformed," as used herein, need not relate to growth control or growth deregulation.

Among said procedures for preparation of a polypeptide of the invention in recombinant form, the preparation procedures employing a vector, and/or a cell transformed by said vector and/or a transgenic organism comprising one of said transformed cells, containing a nucleotide sequence according to the invention coding for a polypeptide of *Alicyclobacillus acidocaldarius*.

A variant according to the invention may consist of producing a recombinant polypeptide fused to a "carrier" protein (chimeric protein). The advantage of this system is that it may allow stabilization of and/or a decrease in the proteolysis of the recombinant product, an increase in the solubility in the course of renaturation in vitro and/or a simplification of the purification when the fusion partner has an affinity for a specific ligand.

More particularly, the invention relates to a procedure for preparation of a polypeptide of the invention comprising the following steps: a) culture of transformed cells under conditions allowing the expression of a recombinant polypeptide of a nucleotide sequence according to the invention; b) if need be, recovery of said recombinant polypeptide.

When the procedure for preparation of a polypeptide of the invention employs a transgenic organism according to the invention, the recombinant polypeptide is then extracted from said organism.

The invention also relates to a polypeptide that is capable of being obtained by a procedure of the invention such as described previously.

The invention also comprises a procedure for preparation of a synthetic polypeptide, characterized in that it uses a sequence of amino acids of polypeptides according to the invention.

The invention likewise relates to a synthetic polypeptide obtained by a procedure according to the invention.

The polypeptides according to the invention can likewise be prepared by techniques that are conventional in the field of the synthesis of peptides. This synthesis can be carried out in homogeneous solution or in solid phase.

For example, recourse can be made to the technique of synthesis in an homogeneous solution described by Houben-Weyl in 1974.

This method of synthesis consists in successively condensing, two by two, the successive amino acids in the order required, or in condensing amino acids and fragments formed previously and already containing several amino acids in the appropriate order, or alternatively several fragments previously prepared in this way, it being understood that it will be necessary to protect beforehand all the reactive functions carried by these amino acids or fragments, with the exception of amine functions of one and carboxyls of the other or vice-versa, which must normally be involved in the formation of peptide bonds, especially after activation of the carboxyl function, according to the methods well known in the synthesis of peptides.

Recourse may also be made to the technique described by Merrifield.

To make a peptide chain according to the Merrifield procedure, recourse is made to a very porous polymeric resin, on which is immobilized the first C-terminal amino acid of the chain. This amino acid is immobilized on a resin through its carboxyl group and its amine function is protected. The amino acids that are going to form the peptide chain are thus immobilized, one after the other, on the amino group, which is deprotected beforehand each time, of the portion of the peptide chain already formed, and which is attached to the resin. When the whole of the desired peptide chain has been formed, the protective groups of the different amino acids forming the peptide chain are eliminated and the peptide is detached from the resin with the aid of an acid.

The invention additionally relates to hybrid polypeptides having at least one polypeptide according to the invention, and a sequence of a polypeptide capable of inducing an immune response in man or animals.

Advantageously, the antigenic determinant is such that it is capable of inducing a humoral and/or cellular response.

It will be possible for such a determinant to comprise a polypeptide according to the invention in glycosylated, pegylated, and/or otherwise post-translationally modified form used with a view to obtaining immunogenic compositions capable of inducing the synthesis of antibodies directed against multiple epitopes.

These hybrid molecules can be formed, in part, of a polypeptide carrier molecule or of fragments thereof according to the invention, associated with a possibly immunogenic part, in particular, an epitope of the diphtheria toxin, the tetanus toxin, a surface antigen of the hepatitis B virus (Patent FR 79 21811), the VP1 antigen of the poliomyelitis virus or any other viral or bacterial toxin or antigen.

The procedures for synthesis of hybrid molecules encompass the methods used in genetic engineering for constructing hybrid nucleotide sequences coding for the polypeptide sequences sought. It will be possible, for example, to refer advantageously to the technique for obtainment of genes coding for fusion proteins described by Minton in 1984.

Said hybrid nucleotide sequences coding for a hybrid polypeptide as well as the hybrid polypeptides according to the invention characterized in that they are recombinant polypeptides obtained by the expression of said hybrid nucleotide sequences are likewise part of the invention.

The invention likewise comprises the vectors characterized in that they contain one of said hybrid nucleotide sequences. The host cells transformed by said vectors, the transgenic organisms comprising one of said transformed cells as well as the procedures for preparation of recombinant polypeptides using said vectors, said transformed cells and/or said transgenic organisms are, of course, likewise part of the invention.

The polypeptides according to the invention, the antibodies according to the invention described below and the nucleotide sequences according to the invention can advantageously be employed in procedures for the detection and/or identification of *Alicyclobacillus acidocaldarius*, in a sample capable of containing them. These procedures, according to the specificity of the polypeptides, the antibodies and the nucleotide sequences according to the invention that will be used, will in particular be able to detect and/or to identify *Alicyclobacillus acidocaldarius*.

The polypeptides according to the invention can advantageously be employed in a procedure for the detection and/or the identification of *Alicyclobacillus acidocaldarius* in a sample capable of containing them, characterized in that it comprises the following steps: a) contacting of this sample with a polypeptide or one of its fragments according to the invention (under conditions allowing an immunological reaction between said polypeptide and the antibodies possibly present in the biological sample); and b) demonstration of the antigen-antibody complexes possibly formed.

Any conventional procedure can be employed for carrying out such a detection of the antigen-antibody complexes possibly formed.

By way of non-limiting example, one method brings into play immunoenzymatic processes according to the ELISA technique, by immunofluorescence, or radioimmunological processes (RIA) or their equivalent.

Thus, the invention likewise relates to the polypeptides according to the invention, labeled with the aid of an adequate label, such as, of the enzymatic, fluorescent or radioactive type.

Such methods comprise, for example, the following acts: deposition of determined quantities of a polypeptide composition according to the invention in the wells of a microtiter plate, introduction into said wells of increasing dilutions of serum, or of a biological sample other than that defined previously, having to be analyzed, incubation of the wells of the microtiter plate, introduction into the wells of the microtiter plate of labeled antibodies directed against pig immunoglobulins, the labeling of these antibodies having been carried out with the aid of an enzyme selected from those which are capable of hydrolyzing a substrate by modifying the absorption of the radiation of the latter, at least at a determined wavelength, for example at 550 nm, detection, by comparison with a control test, of the quantity of hydrolyzed substrate.

The polypeptides according to the invention allow monoclonal or polyclonal antibodies to be prepared, which are characterized in that they specifically recognize the polypeptides according to the invention. It will advantageously be possible to prepare the monoclonal antibodies from hybridomas according to the technique described by Kohler and Milstein in 1975. It will be possible to prepare the polyclonal antibodies, for example, by immunization of an animal, in particular a mouse, with a polypeptide or a DNA, according to the invention, associated with an adjuvant of the immune response, and then purification of the specific antibodies contained in the serum of the immunized animals on an affinity column on which the polypeptide, which has served as an antigen, has previously been immobilized. The polyclonal antibodies according to the invention can also be prepared by purification, on an affinity column on which a polypeptide according to the invention has previously been immobilized, of the antibodies contained in the serum of an animal immunologically challenged by *Alicyclobacillus acidocaldarius*, or a polypeptide or fragment according to the invention.

The invention likewise relates to mono- or polyclonal antibodies or their fragments, or chimeric antibodies, characterized in that they are capable of specifically recognizing a polypeptide according to the invention.

It will likewise be possible for the antibodies of the invention to be labeled in the same manner as described previously for the nucleic probes of the invention, such as a labeling of enzymatic, fluorescent or radioactive type.

The invention is additionally directed at a procedure for the detection and/or identification of *Alicyclobacillus acidocaldarius* in a sample, characterized in that it comprises the following steps: a) contacting of the sample with a mono- or polyclonal antibody according to the invention (under conditions allowing an immunological reaction between said antibodies and the polypeptides of *Alicyclobacillus acidocaldarius* possibly present in the biological sample); and b) demonstration of the antigen-antibody complex possibly formed.

The present invention likewise relates to a procedure for the detection and/or the identification of *Alicyclobacillus acidocaldarius* in a sample, characterized in that it employs a nucleotide sequence according to the invention.

More particularly, the invention relates to a procedure for the detection and/or the identification of *Alicyclobacillus acidocaldarius* in a sample, characterized in that it contains the following steps: a) if need be, isolation of the DNA from the sample to be analyzed; b) specific amplification of the DNA of the sample with the aid of at least one primer, or a pair of primers, according to the invention; and c) demonstration of the amplification products.

These can be detected, for example, by the technique of molecular hybridization utilizing a nucleic probe according to the invention. This probe will advantageously be labeled with a nonradioactive (cold probe) or radioactive isotope.

For the purposes of the present invention, "DNA of the biological sample" or "DNA contained in the biological sample" will be understood as meaning either the DNA present in the biological sample considered, or possibly the cDNA obtained after the action of an enzyme of reverse transcriptase type on the RNA present in said biological sample.

A further embodiment of the invention comprises a method, characterized in that it comprises the following acts: a) contacting of a nucleotide probe according to the invention with a biological sample, the DNA contained in the biological sample having, if need be, previously been made accessible to hybridization under conditions allowing the hybridization of the nucleotide probe with the DNA of the sample; and b) demonstration of the hybrid formed between the nucleotide probe and the DNA of the biological sample.

The present invention also relates to a procedure according to the invention, characterized in that it comprises the following acts: a) contacting of a nucleotide probe immobilized on a support according to the invention with a biological sample, the DNA of the sample having, if need be, previously been made accessible to hybridization, under conditions allowing the hybridization of the neucleotide probe with the DNA of the sample; b) contacting of the hybrid formed between the nucleotide probe immobilized on a support and the DNA contained in the biological sample, if need be, after elimination of the DNA of the biological sample that has not hybridized with the probe, with a nucleotide probe labeled according to the invention; c) demonstration of the novel hybrid formed in act b).

According to an advantageous embodiment of the procedure for detection and/or identification defined previously, this is characterized in that, prior to act a), the DNA of the biological sample is first amplified with the aid of at least one primer according to the invention.

Embodiments of methods include methods of altering secondary metabolism in a cell, the methods comprising providing a recombinant, purified, and/or isolated nucleotide sequence comprising a nucleotide sequence selected from the group consisting of a nucleotide sequence having at least 90% sequence identity to at least one of the sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 to the cell.

Further embodiments of methods include placing a cell producing or encoding a recombinant, purified, and/or isolated nucleotide sequence comprising a nucleotide sequence selected from the group consisting of a nucleotide sequence having at least 90% sequence identity to at least one of the sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 in an environment comprising temperatures at or above about 25, 30, 35, 40, 45, 50, 55, 60, 65, 70, 75, 80, 85, 90, and/or 95 degrees Celsius and/or a pH at, below, and/or above 8, 7, 6, 5, 4, 3, 2, 1, and/or 0.

The present invention provides cells that have been genetically manipulated to have an altered capacity to produce expressed proteins. In particular, the present invention relates to Gram-positive microorganisms, such as *Bacillus* species having enhanced expression of a protein of interest, wherein one or more chromosomal genes have been inactivated, and/or wherein one or more chromosomal genes have been deleted from the *Bacillus* chromosome. In some further embodiments, one or more indigenous chromosomal regions have been deleted from a corresponding wild-type *Bacillus* host chromosome. In further embodiments, the *Bacillus* is an *Alicyclobacillus* sp. or *Alicyclobacillus acidocaldarius*.

Additional embodiments, include methods of modulating metabolism at temperatures at or above about 25, 30, 35, 40, 45, 50, 55, 60, 65, 70, 75, 80, 85, 90, and/or 95 degrees Celsius and/or at a pH at, below, and/or above 8, 7, 6, 5, 4, 3, 2, 1, and/or 0 via providing a recombinant, purified, and/or isolated nucleotide sequence comprising a nucleotide sequence selected from the group consisting of a nucleotide sequence having at least 90% sequence identity to at least one of the sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 to a cell.

In embodiments of the invention any one of the isolated and/or purified polypeptides according to the invention may be enzymatically or functionally active at temperatures at or above about 25, 30, 35, 40, 45, 50, 55, 60, 65, 70, 75, 80, 85, 90, and/or 95 degrees Celsius and/or may be enzymatically or functionally active at a pH at, below, and/or above 8, 7, 6, 5, 4, 3, 2, 1, and/or 0. In further embodiments of the invention, glycosylation, pegylation, and/or other post-translational modification may be required for the isolated and/or purified polypeptides according to the invention to be enzymatically or functionally active at a pH at or below 8, 7, 6, 5, 4, 3, 2, 1, and/or 0 or at temperatures at or above about 25, 30, 35, 40, 45, 50, 55, 60, 65, 70, 75, 80, 85, 90, and/or 95 degrees Celsius.

The invention is described in additional detail in the following illustrative examples. Although the examples may represent only selected embodiments of the invention, it should be understood that the following examples are illustrative and not limiting.

EXAMPLES

Example 1

Modulating or Altering Metabolism Using Nucleotide and Amino Acid Sequences from *Alicyclobacillus acidocaldarius*

Provided in SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 are a nucleotide sequence isolated from *Alicyclobacillus acidocaldarius* and coding for the polypeptides of SEQ ID NO: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565, respectively. The nucleotide sequences of SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 are placed into expression vectors using techniques standard in the art. The vectors are then provided to cells such as bacteria cells or eukaryotic cells such as Sf9 cells or CHO cells. In conjunction with the normal machinery in present in the cells, the vectors comprising SEQ ID NOS:2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, and 1566 produce the polypeptides of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565. The polypeptides of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 are then isolated and/or purified. The isolated and/or purified polypeptides of SEQ ID NOS:1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 are then each demonstrated to have one or more of the activities provided in Table 1.

The isolated and/or purified polypeptides of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, and 1565 are demonstrated to have activity as at least one of a (S)-2-hydroxy-acid oxidase, [acyl-carrier-protein] S-malonyltransferase, 1,3-propanediol Dehydrogenase, 2-isopropylmalate Synthase, 3-hydroxybutyryl-CoA dehydratase, 3-isopropylmalate Dehydratase, 3-isopropylmalate Dehydrogenase, 3-oxoacid CoA-transferase, 8-amino-7-oxononanoate Synthase, Acetaldehyde dehydrogenase (acetylating), Acetate-CoA ligase, Acetolactate synthase, Acetyl-CoA C-acetyltransferase, Aconitate hydratase, Alcohol dehydrogenase, Alcohol dehydrogenase (NADP+), Aldehyde dehydrogenase, Aldehyde dehydrogenase (NAD+), ATP phosphoribosyltransferase, ATP synthase alpha chain, ATP synthase B chain, ATP synthase beta chain, ATP synthase C chain, ATP synthase epsilon chain, ATP synthase gamma chain, Biotin synthase, Branched-chain-amino-acid transaminase, Butyryl-CoA dehydrogenase, Citrate (Si)-synthase, Dethiobiotin synthase, Diaminopimelate decarboxylase, Diaminopimelate epimerase, Dihydrodipicolinate reductase, Dihydrodipicolinate synthase, Dihydrolipoyl dehydrogenase, Dihydroxy-acid dehydratase, Enoyl-CoA hydratase, FdhD protein (fdsC), Formate dehydrogenase, Glycerate kinase, Glycine hydroxymethyltransferase, Isocitrate lyase, Lactaldehyde reductase, Lactate 2-monooxygenase, L-lactate dehydrogenase, Malate dehydrogenase, Malate dehydrogenase (acceptor), Malate dehydrogenase (oxaloacetate-decarboxylating), Malate synthase, Malonate-semialdehyde dehydrogenase (acetylating), Methylmalonate-semialdehyde dehydrogenase (acylating), N-acetyl-diaminopimelate deacetylase, Oxoglutarate dehydrogenase (succinyl-transferring), Phosphoenolpyruvate carboxylase, Phosphoglycerate dehydrogenase, Phosphoribosylanthranilate isomerase, Pyruvate dehydrogenase (acetyl-transferring), Pyruvate, phosphate dikinase, Succinate dehydrogenase cytochrome b558 subunit, Succinate dehydrogenase flavoprotein subunit, Succinate dehydrogenase iron-sulfur protein, and Succinate-CoA ligase (ADP-forming).

While this invention has been described in certain embodiments, the present invention can be further modified within the spirit and scope of this disclosure. This application is therefore intended to cover any variations, uses, or adaptations of the invention using its general principles. Further, this application is intended to cover such departures from the present disclosure as come within known or customary practice in the art to which this invention pertains and which fall within the limits of the appended claims and their legal equivalents.

All references, including publications, patents, and patent applications, cited herein are hereby incorporated by reference to the same extent as if each reference were individually and specifically indicated to be incorporated by reference and were set forth in its entirety herein.

While this invention has been described in certain embodiments, the present invention can be further modified within the spirit and scope of this disclosure. This application is therefore intended to cover any variations, uses, or adaptations of the invention using its general principles. Further, this application is intended to cover such departures from the present disclosure as come within known or customary practice in the art to which this invention pertains and which fall within the limits of the appended claims and their legal equivalents.

BIBLIOGRAPHIC REFERENCES

Barany, F., 1991, PNAS. USA, 88: 189-193.
Buckholz, R. G., 1993, Yeast systems for the expression of heterologous gene products. Curr. Op. Biotechnology 4:538-542.
Burg, J. L. et al., 1996, Mol. and Cell. Probes, 10:257-271.
Chu, B. C. F. et al., 1986, NAR, 14:5591-5603.
Duck, P. et al., 1990, Biotechniques, 9:142-147.
Edwards, C. P., and Aruffo, A., 1993, Current applications of COS cell based transient expression systems. Curr. Op. Biotechnology 4:558-563.
Guateli, J. C. et al., 1990, PNAS. USA, 87:1874-1878.
Houben-Weyl, 1974, in Methoden der Organischen Chemie, E. Wunsch Ed., Volume 15-1 and 15-II, Thieme, Stuttgart.
Innis, M. A. et al., 1990, in PCR Protocols. A guide to Methods and Applications, San Diego, Academic Press.
Kievitis, T. et al., 1991, J. Virol. Methods, 35:273-286.
Köhler, G. et al., 1975, Nature, 256(5517):495-497.
Kwoh, D. Y. et al., 1989, PNAS. USA, 86:1173-1177.
Luckow, V. A., 1993, Baculovirus systems for the expression of human gene products. Curr. Op. Biotechnology 4:564-572.
Matthews, J. A. et al., 1988, Anal. Biochem., 169:1-25.
Merrifield, R. D., 1966, J. Am. Chem. Soc., 88(21):5051-5052.
Miele, E. A. et al., 1983, J. Mol. Biol., 171:281-295.
Olins, P. O., and Lee, S. C., 1993, Recent advances in heterologous gene expression in *E. coli*. Curr. Op. Biotechnology 4:520-525.
Rolfs, A. et al., 1991, In PCR Topics. Usage of Polymerase Chain reaction in Genetic and Infectious Disease. Berlin: Springer-Verlag.
Sambrook, J. et al., 1989, In Molecular Cloning: A Laboratory Manual. Cold Spring Harbor, N.Y.: Cold Spring Harbor Laboratory Press.
Sanchez-Pescador, R., 1988, J. Clin. Microbiol., 26(10):1934-1938.
Segev D., 1992, in "Non-radioactive Labeling and Detection of Biomolecules." Kessler C. Springer-Verlag, Berlin, New-York: 197-205.
Urdea, M. S., 1988, Nucleic Acids Research, II:4937-4957.
Walker, G. T. et al., 1992, NAR 20:1691-1696.
Walker, G. T. et al., 1992, PNAS USA, 89:392-396.
White, B. A. et al., 1997, Methods in Molecular Biology, 67, Humana Press, Totowa, N.J.

SEQUENCE LISTING (1581 sequences)

SEQ ID NO: 1 - protein, 649 aa, Alicyclobacillus acidocaldarius
MTPNDLDALLRETRTFAPSEEFRRQANYKDESIYEEAARDPEGYWAKQAEHITWFHEFESVCRWDPPHAQWFIGGKLNAAYNCVDRHTLTHRKNKAAIIWEGEPGDSRVLTYDMLRREVDKAAHMLTQLGVKKGDRVTIYLPMVPELPIAMLACAKIGAMHSVVFGGFSAQALKDRILDAGSKLLITADGGWRRGKVIPLKQNADEAVVGTPIEKVVVVQRIGEAAQAAMDPARDVWWHEAMQSAPTKPFPAEPMDAEDYLFLLYTSGTTGKPKGIVHSTGGYLVGVNTSMRTVFDLKDEDVFFCTADIGWITGHTYIVYGPLSAGATVVMYEGSPDYPDRDRYWAIVEKYGATILYTAPTSIRMFMKWGPQYVEKHDLSTLRLLGSVGEPINPEAWMWYHKYVGQERCPIVDTWWQTETGCAMIAPLPGIITTKPGSATKPVPGISVDILDDDGNPVPPGHGGNLVITKPWPSMLRTVWGDDERFRKTYFEKFEGIYLPGDGAYRDQDGYYWIVGRLDDVINVSGHRIGTAEVESALVAHPAVAEAAVIGRAHEVKGQAITAFVILKEGHTGSDDLVSELKQFVVEQIGAMARPEEIIFTADLPKTRSGKIMRRLLRDIAEGRVVGDTTTLADPAVVEQLKSQYKDQE

SEQ ID NO: 2 - DNA, 1950 bp, Alicyclobacillus acidocaldarius
atgaccccgaatgatctcgacgcactactccgtgaaacccgcacctttgccccgtccgaagaatttcgccgccaagcgaattacaaggatgaaagcatttacgaggaagctgctcgtgatccagagggttactgggcgaaacaagccgaacatattacttggttccatgaatttgaaagcgtttgcaggtgggatccgccgcacgcgcaatggttcatcggcggcaagctgaacgccgcgtataactgcgtggaccgtcacaccctcactcaccgcaagaataaggcggccatcatctgggaaggcgagccaggcgacagccgcgtcctcacgtacgacatgttgcgccgcgaagtcgataaggccgcacacatgctcacccagcttggggtcaaaaagggcgatcgcgtcaccatctacctgcccatggtgcccgagctccccattgcgatgctcgcgtgcgccaaaatcggcgccatgcattccgtcgtgttcggcggattttccgcgcaggcgctgaaggatcgcatcctggacgccggcagcaagctgctcatcacggcggacggaggctggcgccgcggcaaggtcattccgctcaagcagaacgcggacgaagccgtcgtgggaacgcccatcgagaaggttgtggtcgtccagcggatcggcgaagcggctcaggcagccatggatccggcgcgagacgtctggtggcacgaagccatgcagagcgcgccgaccaagcccttcccggctgagcccatggacgcggaagactacctgttcctgctctacacgtctggcaccacgggcaagccgaagggcattgtccacagcacgggcggatacctggtgggcgtcaacacgtccatgcggaccgtgttcgatctgaaggacgaagacgtgttcttctgcacggcggacatcggctggatcaccggccacacgtacatcgtgtacggcccgctgtcggccggcgcgacggtcgtcatgtacgagggatcgcccgattatcccgatcgcgaccggtactgggccatcgtcgagaagtacggcgcgaccatcctgtacaccgcgccgacatccatccgcatgttcatgaaatggggtccccagtacgtcgaaaagcacgatctcagcacgctccggctgctcggatctgtcggcgagcccattaacccggaggcgtggatgtggtaccacaagtacgtcggccaggagcggtgccccatcgtggacacctggtggcagacggaaaccggttgcgcgatgatcgcgcctctgccaggcattatcaccaccaagccgggttctgccaccaagcccgtgcccggcatctccgtcgatatccttgacgacgacggcaatccggtgccgccggggcatggcggaaatctcgtcatcaccaagccctggccgtccatgctgcgcacggtgtggggcgatgacgagcgcttccgcaagacgtacttcgagaagttcgagggcatctacctgcctggggacggcgcgtaccgagatcaggatggctactactggattgtcggacggctggacgacgtgatcaacgtgtcgggccaccgcattggcactgcggaagtggagagcgcgctggtggctcatcccgctgtcgccgaggcggccgtgatcgggcgcgcccacgaagtcaaggggcaggccatcaccgcgtttgtcatcctcaaagagggccacaccggttcggacgatctcgtctcggaactgaagcaattcgtcgtcgagcaaatcggcgccatggcgcggccggaggagatcatcttcacggccgatctgcccaagacgcgcagcggcaagattatgcgccgcctgttgcgcgacatcgcggaaggccgtgtggtcggcgacaccaccaccctggccgatccggccgtcgtggagcaactgaaatcgcagtacaaggatcaggaatga

SEQ ID NO: 3 - protein, 652 aa, Symbiobacterium thermophilum IAM 14863
MDSKQFAALLNEDRRFPPPAEFAARANVADESLYEQAARDREGFWAAQAERLHWFRRWDKVLEWNPPFAQWFLGGKLNVAYNCLDRHLQTHTRTKAAIIWEGEPGDERVLTYLDLHREVCRFANVLRQMGVGKGDRVTIYLPMIPEAAVAMLACTRIGAIHSVVFGGFSAESLRDRINDSRSKVVVTADGGWRRGNIIRMKQIVNEAVVDCASVEKVIVVKRIGHESLVEHGWHPGRDHWYHTLMRNAPVTCPVEEMDAEDPLFILYTSGSTGKPKGVLHTTGGYLTQVAATTKYVFDLKDEDVYWCSADIGWITGHSYVIYGPLANGATTLMYEGAPDYPDRGRIWEIIQKYRVNIFYTAPTLIRSFMRWGEGWPSKYDLSSLRLLGTVGEPINPEAWMWYHKHIGGERCPIVDTWWQTETGAIMATPLPGVVHTKPGSTTRPFPGIEMAVVNEEGQEVPPGAGGYLVVKSPWPSMLRTVWGDPDRYVSTYFGRFGHQVYFTGDGAKRDEDGYYWIIGRVDDVINVSGHRIGTMEVESALVDHPLVAEAAVIGRSHAVKGQAITAFVTLKEGRRGTPDLVDELKQHVVTKIGALARPEEIYFAADLPKTRSGKIMRRLLRDIAEGRALGDTTTLADPNVVAQLRQQYESQE

SEQ ID NO: 4 - protein, 644 aa, Carboxydothermus hydrogenoformans Z-2901
DNFEALLQESRIFEPPAEFKEKAKVADLSLYEWAERDFLGFWADAAKDIEWFLPFEKVLDDSDAPFYRWYTGGKLNVSYNCVDRHTKSFRRNKAALIFEGEPGDSKILTYQELYREVNKFANVLKKLGVQKGDRVTIYMPMIPEAVIAMLACTRIGAPHSVVFGGFSSQALKDRIDDAKAKLLITADGGYRRGSIVELKKNADAALEGETTIEKVVVVKRTGQEVPMTEGRDYWYHELMADAALYCEPEQCDAEDMLFILYSSGTTGKPKGIQHTTGGYLVGVHTTFKYIFDYREEDIYWCTADIGWITGHSYIVYGPLSNGATVVLYEGAPDWPQKDRFWEIIEKYRVNILYTAPTAIRTFMRWGEKWPKGRDLSSLRLLGTVGEPINPEAWIWYHEHIGGGRCPIVDTWWQTETGMIMITPLPGVIPTKPGSATKPFPGVEADVVNDKGEPVPPGQGGYLVLKKPWPAMLRTLYGDPERYKNTYWSKFPGWYFTGDGAKKDEDGYFWILGRVDDVINVSGHRIGTMEVESALVEHPLVAEAAVIGKSHEVKGQAIAAFVTLKEGVEGTPELVQELKQFVAQKIGALARPDDIFFTAELPKTRSGKIMRRLLRDIAEGRALGDTTTLTDPAVINKIKEQYKDE

SEQ ID NO: 5 - protein, 643 aa, Desulfitobacterium hafniense Y51
MEEKNLEALLEEDRQFIPSEEFHKNALIQSADIYEQGQSLGFWEEQAKQLSWLSPWEKTLEWNPPFAQWFVGGKLNASANCLDRHLQDWHRNKAAIIFEGENGDSQVLTYQDLHREVSKFANVLKANGVNKGDRVTIYLPMIPEAVISMLACARIGAPHSVVFGGFSSEALRDRVIDAQAKAVITSDGSFRRGNTIPLKDNTDIALDGVDCVEHVFVIQRTKQTVQMKEERDLWYHEEMAKASPVCPAEPMDAEDMLFILYTSGTTGKPKGVVHTTGGYMVGVSTTHRWVFDLKEEDVYWCTADVGWITGHSYIVYGPLANGATVLMYEGSPDYPNRDRFWEIVEKYKVTILYTAPTAIRTFMKWGPQYPQSRDLSSLRLLGSVGEPINPEAWMWYYKYIGGERCPIVDTWWQTETGMIMMTPLPGITSLKPGSCTVPFPGVRIEVVDSAGHPVPKGGGGYLAIKEPWPAMLRNIYGDPARFERTYFGNWPGVYFPGDGAKWDKDGYFWILGRVDDVINVSGHRIGTMEVESALVDHPSVAEAAVIGKNHEVKGQALACFVTLKEGIEITPDLEDELKKHVAKKIGALARPDDIFFTAELPKTRSGKIMRRLLRDIAEGRAIGDTTTLADASVVNTLKANYQE

SEQ ID NO: 6 - protein, 631 aa, Rubrobacter xylanophilus DSM 9941
RTYDPPEEFASRANVRDPGVYEEAARDYEGFWAERARKLHWFREWDEVLRWDPPEAQWFVGGKINASYNCLDYQVQQGRGDKRAIIWEGDEPGENRTLTYSELKAEVEKFANVLKGLGVRKGDAVSIYLPMIPELPIAMLACARIGAPHSVVFGAFSAQSLRDRINDCEAKVLVTADSGPRGGKRTPLKANADEALEDTPSIEKVVVVRRTGDEVNMVEGRDLWWHELMREAEPECPAEEMDSEDILYILYSSGSTGKPKGIVHTTGGYLTHVNTTTDWVFDLKEDDVYWCTADIGWVTGHSYIVYGPLSNGATALMFEGTPSYPANDRWWDIIERHGVTILYTAPTAIRAFMKQGPGPIEKHDLSSLRLLGSVGEPINPRAWEWYHEHVGGGRCPVVDTWWQTETGGIMISPLPGITRTKPGSATFPLPGIFAGIYDEEGNEIEGPGVGNLVIKRPWPGMLRTLYKDPERFRETYWQKYGDVYFSGDGARRDEDGYFWVTGRVDDVINVSGHRISTAEVESALVAHPAVAEAAVIGRYDEDTGQAIVAYVILEGGREGNDELAQELRQQVRKVIGAHARPQEIIFTPDLPKTRSGKIMRRILRSLSEGRDDLGDTTTLADPGVVESLKEQ

SEQ ID NO: 7 - protein, 642 aa, Thermus thermophilus HB8
LESVLKEERVFYPSEEFRKQAHIKSEEEYQRLYEESVRDPEGFWGRVASELHWFEPWRKVLEGDLPHPKWFVGGKTNLSYNALDRHVKTWRRNKAAIVWEGEPGEERVLTYHDLWREVQRFANVLKRLGVKKGDRVTIYLPMIPEAAIAMLACTRIGAVHSVVFGGFSAGALADRIKDAEAKVLITADGGFRRGGIVPLKQNADEALKDATSVEHVVVVRRTGEEVPWTPGRDHWWHELMEAAPDRCDPEPMEAEEPLFILYTSGSTGKPKGVLHTTGGYMTYVYYTTKLVFDLKDEDVYWCTADVGWITGHSYVVYGPLLNGATTVMYEGAPNWPEPDRFWRIVDKYGVTVFYTAPTAIRSFMKWGEGWPGKHRLDSLRLLGTVGEPINPEAWLWYYHVIGKGRCPIVDTWWQTETGGIMITTLPGAHAMKPGHAGKPFFGVVPEILDGEHRPVENPDEGGHLCITRPWPSMLRTVWGDPERFLQQYFSQHPGVYFSGDGAKRDKDGYYMILGRVDDVLNVAGHRLGTMEIESALVAHPAVAEAAVVGRPDPVKGEAIVAFVTLKEGHTPSDALKEELRAHVAKVIGPIARPDEIRFTDALPKTRSGKIMRRLLRQIAAGEKEIKGDTSTLEDRSVVERLK

SEQ ID NO: 8 - protein, 649 aa, Artificial
  Substituion in SEQ ID NO 1
MTPNDLDALLRETRTFAPSEEFRRQANYKDESIYEEAARDPEGYWAKQAEHITWFHEFESVCRWDPPHAQWFIGGKLNAAYNCVDRHTLTHRKNKAAIIWEGEPGDSRVLTYDMLRREVDKAAHMLTQLGVKKGDRVTIYLPMVPELPIAMLACAKIGAMHSVVFGGFSAQALKDRILDAGSKLLITADGGWRRGKVIPLKQNADEAVVGTPIEKVVVVQRIGEAAQAAMDPARDVWWHEAMQSAPTKPFPAEPMDAEDYLFLLYTSGTTGKPKGIVHSTGGYLVGVNTSMRTVFDLKDEDVFFCTADIGWITGHTYIVYGPLSAGATVVMYEGSPDYPDRDRYWAIVEKYGATILYTAPTSIRMFMKWGPQYVEKHDLSTLRLLGSVGEPINPEAWMWYHKYVGQERCPIVDTWWQTETGCAMIAPLPGIITTKPGSATKPVPGISVDIIDDDGNPVPPGHGGNLVITKPWPSMLRTVWGDDERFRKTYFEKFEGIYLPGDGAYRDQDGYYWIVGRLDDVINVSGHRIGTAEVESALVAHPAVAEAAVIGRAHEVKGQAITAFVILKEGHTGSDDLVSELKQFVVEQIGAMARPEEIIFTADLPKTRSGKIMRRLLRDIAEGRVVGDTTTLADPAVVEQLKSQYKDQE

SEQ ID NO: 9 - protein, 649 aa, Artificial
  Substituion in SEQ ID NO 1
MTPNDLDALLRETRTFAPSEEFRRQANYKDESIYEEAARDPEGYWAKQAEHITWFHEFESVCRWDPPHAQWFIGGKLNAAYNCVDRHTLTHRKNKAAIIWEGEPGDSRVLTYDMLRREVDKAAHMLTQLGVKKGDRVTIYLPMVPELPIAMLACAKIGAMHSVVFGGFSAQALKDRILDAGSKLLITADGGWRRGKVIPLKQNADEAVVGTPIEKVVVVQRIGEAAQAAMDPARDVWWHEAMQSAPTKPFPAEPMDAEDYLFLLYTSGTTGKPKGIVHSTGGYLVGVNTSMRTVFDLKDEDVFFCTADIGWITGHTYIVYGPLSAGATVVMYEGSPDYPDRDRYWAIVEKYGATILYTAPTSIRMFMKWGPQYVEKHDLSTLRLLGSVGEPINPEAWMWYHKYVGQERCPIVDTWWQTETGCAMIAPLPGIITTKPGSATKPVPGISVDILDDDGNPVPPGHGGNLVITKPWPSMLRTVWGDDERFRKTYFEKFEGIYLPGDGAYRDQDGYYWIIGRLDDVINVSGHRIGTAEVESALVAHPAVAEAAVIGRAHEVKGQAITAFVILKEGHTGSDDLVSELKQFVVEQIGAMARPEEIIFTADLPKTRSGKIMRRLLRDIAEGRVVGDTTTLADPAVVEQLKSQYKDQE

SEQ ID NO: 10 - protein, 649 aa, Artificial
  Substituion in SEQ ID NO 1
MTPNDLDALLRETRTFAPSEEFRRQANYKDESIYEEAARDPEGYWAKQAEHITWFHEFESVCRWDPPHAQWFIGGKLNAAYNCVDRHTLTHRKNKAAIIWEGEPGDSRVLTYDMLRREVDKAAHMLTQLGVKKGDRVTIYLPMVPELPIAMLACAKIGAMHSVVFGGFSAQALKDRILDAGSKLLITADGGWRRGKVIPLKQNADEAVVGTPIEKVVVVQRIGEAAQAAMDPARDVWWHEAMQSAPTKPFPAEPMDAEDYLFLLYTSGTTGKPKGIVHSTGGYLVGVNTSMRTVFDLKDEDVFFCTADIGWITGHTYIVYGPLSAGATVVMYEGSPDYPDRDRYWAIVEKYGATILYTAPTSIRMFMKWGPQYVEKHELSTLRLLGSVGEPINPEAWMWYHKYVGQERCPIVDTWWQTETGCAMIAPLPGIITTKPGSATKPVPGISVDILDDDGNPVPPGHGGNLVITKPWPSMLRTVWGDDERFRKTYFEKFEGIYLPGDGAYRDQDGYYWIVGRLDDVINVSGHRIGTAEVESALVAHPAVAEAAVIGRAHEVKGQAITAFVILKEGHTGSDDLVSELKQFVVEQIGAMARPEEIIFTADLPKTRSGKIMRRLLRDIAEGRVVGDTTTLADPAVVEQLKSQYKDQE

SEQ ID NO: 11 - protein, 649 aa, Artificial
  Substituion in SEQ ID NO 1
MTPNDLDALLRETRTFAPSEEFRRQANYKDESIYEEAARDPEGYWAKQAEHITWFHEFESVCRWDPPHAQWFIGGKLNAAYNCVDRHTLTHRKNKAAIIWEGEPGDSRVLTYDMLRREVDKAAHMLTQLGVKKGDRVTIYLPMVPELPIAMLACAKIGAMHSVVFGGFSAQALKDRILDAGSKLLITADGGWRRGKVLPLKQNADEAVVGTPIEKVVVVQRIGEAAQAAMDPARDVWWHEAMQSAPTKPFPAEPMDAEDYLFLLYTSGTTGKPKGIVHSTGGYLVGVNTSMRTVFDLKDEDVFFCTADIGWITGHTYIVYGPLSAGATVVMYEGSPDYPDRDRYWAIVEKYGATILYTAPTSIRMFMKWGPQYVEKHDLSTLRLLGSVGEPINPEAWMWYHKYVGQERCPIVDTWWQTETGCAMIAPLPGIITTKPGSATKPVPGISVDILDDDGNPVPPGHGGNLVITKPWPSMLRTVWGDDERFRKTYFEKFEGIYLPGDGAYRDQDGYYWIVGRLDDVINVSGHRIGTAEVESALVAHPAVAEAAVIGRAHEVKGQAITAFVILKEGHTGSDDLVSELKQFVVEQIGAMARPEEIIFTADLPKTRSGKIMRRLLRDIAEGRVVGDTTTLADPAVVEQLKSQYKDQE

SEQ ID NO: 12 - protein, 649 aa, Artificial
  Substituion in SEQ ID NO 1
MTPNDLDALLRETRTFAPSEEFRRQANYKDESIYEDAARDPEGYWAKQAEHITWFHEFESVCRWDPPHAQWFIGGKLNAAYNCVDRHTLTHRKNKAAIIWEGEPGDSRVLTYDMLRREVDKAAHMLTQLGVKKGDRVTIYLPMVPELPIAMLACAKIGAMHSVVFGGFSAQALKDRILDAGSKLLITADGGWRRGKVIPLKQNADEAVVGTPIEKVVVVQRIGEAAQAAMDPARDVWWHEAMQSAPTKPFPAEPMDAEDYLFLLYTSGTTGKPKGIVHSTGGYLVGVNTSMRTVFDLKDEDVFFCTADIGWITGHTYIVYGPLSAGATVVMYEGSPDYPDRDRYWAIVEKYGATILYTAPTSIRMFMKWGPQYVEKHDLSTLRLLGSVGEPINPEAWMWYHKYVGQERCPIVDTWWQTETGCAMIAPLPGIITTKPGSATKPVPGISVDILDDDGNPVPPGHGGNLVITKPWPSMLRTVWGDDERFRKTYFEKFEGIYLPGDGAYRDQDGYYWIVGRLDDVINVSGHRIGTAEVESALVAHPAVAEAAVIGRAHEVKGQAITAFVILKEGHTGSDDLVSELKQFVVEQIGAMARPEEIIFTADLPKTRSGKIMRRLLRDIAEGRVVGDTTTLADPAVVEQLKSQYKDQE

SEQ ID NO: 13 - DNA, 1950 bp, Artificial
  Substituion in SEQ ID NO 2
atgaccccgaatgatctcgacgcactactccgtgaaacccgcacctttgccccgtccgaagaatttcgccgccaagcgaattacaaggatgaaagcatttacgaggaagctgctcgtgatccagagggttactgggcgaaacaagccgaacatattacttggttccatgaatttgaaagcgtttgcaggtgggatccgccgcacgcgcaatggttcatcggcggcaagctgaacgccgcgtataactgcgtggaccgtcacaccctcactcaccgcaagaataaggcggccatcatctgggaaggcgagccaggcgacagccgcgtcctcacgtacgacatgttgcgccgcgaagtcgataaggccgcacacatgctcacccagcttggggtcaaaaagggcgatcgcgtcaccatctacctgcccatggtgcccgagctccccattgcgatgctcgcgtgcgccaaaatcggcgccatgcattccgtcgtgttcggcggattttccgcgcaggcgctgaaggatcgcatcctggacgccggcagcaagctgctcatcacggcggacggaggctggcgccgcggcaaggtcattccgctcaagcagaacgcggacgaagccgtcgtgggaacgcccatcgagaaggttgtggtcgtccagcggatcggcgaagcggctcaggcagccatggatccggcgcgagacgtctggtggcacgaagccatgcagagcgcgccgaccaagcccttcccggctgagcccatggacgcggaagactacctgttcctgctctacacgtctggcaccacgggcaagccgaagggcattgtccacagcacgggcggatacctggtgggcgtcaacacgtccatgcggaccgtgttcgatctgaaggacgaagacgtgttcttctgcacggcggacatcggctggatcaccggccacacgtacatcgtgtacggcccgctgtcggccggcgcgacggtcgtcatgtacgagggatcgcccgattatcccgatcgcgaccggtactgggccatcgtcgagaagtacggcgcgaccatcctgtacaccgcgccgacatccatccgcatgttcatgaaatggggtccccagtacgtcgaaaagcacgatctcagcacgctccggctgctcggatctgtcggcgagcccattaacccggaggcgtggatgtggtaccacaagtacgtcggccaggagcggtgccccatcgtggacacctggtggcagacggaaaccggttgcgcgatgatcgcgcctctgccaggcattatcaccaccaagccgggttctgccaccaagcccgtgcccggcatctccgtcgatatcattgacgacgacggcaatccggtgccgccggggcatggcggaaatctcgtcatcaccaagccctggccgtccatgctgcgcacggtgtggggcgatgacgagcgcttccgcaagacgtacttcgagaagttcgagggcatctacctgcctggggacggcgcgtaccgagatcaggatggctactactggattgtcggacggctggacgacgtgatcaacgtgtcgggccaccgcattggcactgcggaagtggagagcgcgctggtggctcatcccgctgtcgccgaggcggccgtgatcgggcgcgcccacgaagtcaaggggcaggccatcaccgcgtttgtcatcctcaaagagggccacaccggttcggacgatctcgtctcggaactgaagcaattcgtcgtcgagcaaatcggcgccatggcgcggccggaggagatcatcttcacggccgatctgcccaagacgcgcagcggcaagattatgcgccgcctgttgcgcgacatcgcggaaggccgtgtggtcggcgacaccaccaccctggccgatccggccgtcgtggagcaactgaaatcgcagtacaaggatcaggaatga

SEQ ID NO: 14 - DNA, 1950 bp, Artificial
  Substituion in SEQ ID NO 2
atgaccccgaatgatctcgacgcactactccgtgaaacccgcacctttgccccgtccgaagaatttcgccgccaagcgaattacaaggatgaaagcatttacgaggaagctgctcgtgatccagagggttactgggcgaaacaagccgaacatattacttggttccatgaatttgaaagcgtttgcaggtgggatccgccgcacgcgcaatggttcatcggcggcaagctgaacgccgcgtataactgcgtggaccgtcacaccctcactcaccgcaagaataaggcggccatcatctgggaaggcgagccaggcgacagccgcgtcctcacgtacgacatgttgcgccgcgaagtcgataaggccgcacacatgctcacccagcttggggtcaaaaagggcgatcgcgtcaccatctacctgcccatggtgcccgagctccccattgcgatgctcgcgtgcgccaaaatcggcgccatgcattccgtcgtgttcggcggattttccgcgcaggcgctgaaggatcgcatcctggacgccggcagcaagctgctcatcacggcggacggaggctggcgccgcggcaaggtcattccgctcaagcagaacgcggacgaagccgtcgtgggaacgcccatcgagaaggttgtggtcgtccagcggatcggcgaagcggctcaggcagccatggatccggcgcgagacgtctggtggcacgaagccatgcagagcgcgccgaccaagcccttcccggctgagcccatggacgcggaagactacctgttcctgctctacacgtctggcaccacgggcaagccgaagggcattgtccacagcacgggcggatacctggtgggcgtcaacacgtccatgcggaccgtgttcgatctgaaggacgaagacgtgttcttctgcacggcggacatcggctggatcaccggccacacgtacatcgtgtacggcccgctgtcggccggcgcgacggtcgtcatgtacgagggatcgcccgattatcccgatcgcgaccggtactgggccatcgtcgagaagtacggcgcgaccatcctgtacaccgcgccgacatccatccgcatgttcatgaaatggggtccccagtacgtcgaaaagcacgatctcagcacgctccggctgctcggatctgtcggcgagcccattaacccggaggcgtggatgtggtaccacaagtacgtcggccaggagcggtgccccatcgtggacacctggtggcagacggaaaccggttgcgcgatgatcgcgcctctgccaggcattatcaccaccaagccgggttctgccaccaagcccgtgcccggcatctccgtcgatatccttgacgacgacggcaatccggtgccgccggggcatggcggaaatctcgtcatcaccaagccctggccgtccatgctgcgcacggtgtggggcgatgacgagcgcttccgcaagacgtacttcgagaagttcgagggcatctacctgcctggggacggcgcgtaccgagatcaggatggctactactggattattggacggctggacgacgtgatcaacgtgtcgggccaccgcattggcactgcggaagtggagagcgcgctggtggctcatcccgctgtcgccgaggcggccgtgatcgggcgcgcccacgaagtcaaggggcaggccatcaccgcgtttgtcatcctcaaagagggccacaccggttcggacgatctcgtctcggaactgaagcaattcgtcgtcgagcaaatcggcgccatggcgcggccggaggagatcatcttcacggccgatctgcccaagacgcgcagcggcaagattatgcgccgcctgttgcgcgacatcgcggaaggccgtgtggtcggcgacaccaccaccctggccgatccggccgtcgtggagcaactgaaatcgcagtacaaggatcaggaatga

SEQ ID NO: 15 - DNA, 1950 bp, Artificial
  Substituion in SEQ ID NO 2
atgaccccgaatgatctcgacgcactactccgtgaaacccgcacctttgccccgtccgaagaatttcgccgccaagcgaattacaaggatgaaagcatttacgaggaagctgctcgtgatccagagggttactgggcgaaacaagccgaacatattacttggttccatgaatttgaaagcgtttgcaggtgggatccgccgcacgcgcaatggttcatcggcggcaagctgaacgccgcgtataactgcgtggaccgtcacaccctcactcaccgcaagaataaggcggccatcatctgggaaggcgagccaggcgacagccgcgtcctcacgtacgacatgttgcgccgcgaagtcgataaggccgcacacatgctcacccagcttggggtcaaaaagggcgatcgcgtcaccatctacctgcccatggtgcccgagctccccattgcgatgctcgcgtgcgccaaaatcggcgccatgcattccgtcgtgttcggcggattttccgcgcaggcgctgaaggatcgcatcctggacgccggcagcaagctgctcatcacggcggacggaggctggcgccgcggcaaggtcattccgctcaagcagaacgcggacgaagccgtcgtgggaacgcccatcgagaaggttgtggtcgtccagcggatcggcgaagcggctcaggcagccatggatccggcgcgagacgtctggtggcacgaagccatgcagagcgcgccgaccaagcccttcccggctgagcccatggacgcggaagactacctgttcctgctctacacgtctggcaccacgggcaagccgaagggcattgtccacagcacgggcggatacctggtgggcgtcaacacgtccatgcggaccgtgttcgatctgaaggacgaagacgtgttcttctgcacggcggacatcggctggatcaccggccacacgtacatcgtgtacggcccgctgtcggccggcgcgacggtcgtcatgtacgagggatcgcccgattatcccgatcgcgaccggtactgggccatcgtcgagaagtacggcgcgaccatcctgtacaccgcgccgacatccatccgcatgttcatgaaatggggtccccagtacgtcgaaaagcacgaactcagcacgctccggctgctcggatctgtcggcgagcccattaacccggaggcgtggatgtggtaccacaagtacgtcggccaggagcggtgccccatcgtggacacctggtggcagacggaaaccggttgcgcgatgatcgcgcctctgccaggcattatcaccaccaagccgggttctgccaccaagcccgtgcccggcatctccgtcgatatccttgacgacgacggcaatccggtgccgccggggcatggcggaaatctcgtcatcaccaagccctggccgtccatgctgcgcacggtgtggggcgatgacgagcgcttccgcaagacgtacttcgagaagttcgagggcatctacctgcctggggacggcgcgtaccgagatcaggatggctactactggattgtcggacggctggacgacgtgatcaacgtgtcgggccaccgcattggcactgcggaagtggagagcgcgctggtggctcatcccgctgtcgccgaggcggccgtgatcgggcgcgcccacgaagtcaaggggcaggccatcaccgcgtttgtcatcctcaaagagggccacaccggttcggacgatctcgtctcggaactgaagcaattcgtcgtcgagcaaatcggcgccatggcgcggccggaggagatcatcttcacggccgatctgcccaagacgcgcagcggcaagattatgcgccgcctgttgcgcgacatcgcggaaggccgtgtggtcggcgacaccaccaccctggccgatccggccgtcgtggagcaactgaaatcgcagtacaaggatcaggaatga

SEQ ID NO: 16 - DNA, 1950 bp, Artificial
  Substituion in SEQ ID NO 2
atgaccccgaatgatctcgacgcactactccgtgaaacccgcacctttgccccgtccgaagaatttcgccgccaagcgaattacaaggatgaaagcatttacgaggaagctgctcgtgatccagagggttactgggcgaaacaagccgaacatattacttggttccatgaatttgaaagcgtttgcaggtgggatccgccgcacgcgcaatggttcatcggcggcaagctgaacgccgcgtataactgcgtggaccgtcacaccctcactcaccgcaagaataaggcggccatcatctgggaaggcgagccaggcgacagccgcgtcctcacgtacgacatgttgcgccgcgaagtcgataaggccgcacacatgctcacccagcttggggtcaaaaagggcgatcgcgtcaccatctacctgcccatggtgcccgagctccccattgcgatgctcgcgtgcgccaaaatcggcgccatgcattccgtcgtgttcggcggattttccgcgcaggcgctgaaggatcgcatcctggacgccggcagcaagctgctcatcacggcggacggaggctggcgccgcggcaaggtcttaccgctcaagcagaacgcggacgaagccgtcgtgggaacgcccatcgagaaggttgtggtcgtccagcggatcggcgaagcggctcaggcagccatggatccggcgcgagacgtctggtggcacgaagccatgcagagcgcgccgaccaagcccttcccggctgagcccatggacgcggaagactacctgttcctgctctacacgtctggcaccacgggcaagccgaagggcattgtccacagcacgggcggatacctggtgggcgtcaacacgtccatgcggaccgtgttcgatctgaaggacgaagacgtgttcttctgcacggcggacatcggctggatcaccggccacacgtacatcgtgtacggcccgctgtcggccggcgcgacggtcgtcatgtacgagggatcgcccgattatcccgatcgcgaccggtactgggccatcgtcgagaagtacggcgcgaccatcctgtacaccgcgccgacatccatccgcatgttcatgaaatggggtccccagtacgtcgaaaagcacgatctcagcacgctccggctgctcggatctgtcggcgagcccattaacccggaggcgtggatgtggtaccacaagtacgtcggccaggagcggtgccccatcgtggacacctggtggcagacggaaaccggttgcgcgatgatcgcgcctctgccaggcattatcaccaccaagccgggttctgccaccaagcccgtgcccggcatctccgtcgatatccttgacgacgacggcaatccggtgccgccggggcatggcggaaatctcgtcatcaccaagccctggccgtccatgctgcgcacggtgtggggcgatgacgagcgcttccgcaagacgtacttcgagaagttcgagggcatctacctgcctggggacggcgcgtaccgagatcaggatggctactactggattgtcggacggctggacgacgtgatcaacgtgtcgggccaccgcattggcactgcggaagtggagagcgcgctggtggctcatcccgctgtcgccgaggcggccgtgatcgggcgcgcccacgaagtcaaggggcaggccatcaccgcgtttgtcatcctcaaagagggccacaccggttcggacgatctcgtctcggaactgaagcaattcgtcgtcgagcaaatcggcgccatggcgcggccggaggagatcatcttcacggccgatctgcccaagacgcgcagcggcaagattatgcgccgcctgttgcgcgacatcgcggaaggccgtgtggtcggcgacaccaccaccctggccgatccggccgtcgtggagcaactgaaatcgcagtacaaggatcaggaatga

SEQ ID NO: 17 - DNA, 1950 bp, Artificial
  Substituion in SEQ ID NO 2
atgaccccgaatgatctcgacgcactactccgtgaaacccgcacctttgccccgtccgaagaatttcgccgccaagcgaattacaaggatgaaagcatttacgaggatgctgctcgtgatccagagggttactgggcgaaacaagccgaacatattacttggttccatgaatttgaaagcgtttgcaggtgggatccgccgcacgcgcaatggttcatcggcggcaagctgaacgccgcgtataactgcgtggaccgtcacaccctcactcaccgcaagaataaggcggccatcatctgggaaggcgagccaggcgacagccgcgtcctcacgtacgacatgttgcgccgcgaagtcgataaggccgcacacatgctcacccagcttggggtcaaaaagggcgatcgcgtcaccatctacctgcccatggtgcccgagctccccattgcgatgctcgcgtgcgccaaaatcggcgccatgcattccgtcgtgttcggcggattttccgcgcaggcgctgaaggatcgcatcctggacgccggcagcaagctgctcatcacggcggacggaggctggcgccgcggcaaggtcattccgctcaagcagaacgcggacgaagccgtcgtgggaacgcccatcgagaaggttgtggtcgtccagcggatcggcgaagcggctcaggcagccatggatccggcgcgagacgtctggtggcacgaagccatgcagagcgcgccgaccaagcccttcccggctgagcccatggacgcggaagactacctgttcctgctctacacgtctggcaccacgggcaagccgaagggcattgtccacagcacgggcggatacctggtgggcgtcaacacgtccatgcggaccgtgttcgatctgaaggacgaagacgtgttcttctgcacggcggacatcggctggatcaccggccacacgtacatcgtgtacggcccgctgtcggccggcgcgacggtcgtcatgtacgagggatcgcccgattatcccgatcgcgaccggtactgggccatcgtcgagaagtacggcgcgaccatcctgtacaccgcgccgacatccatccgcatgttcatgaaatggggtccccagtacgtcgaaaagcacgatctcagcacgctccggctgctcggatctgtcggcgagcccattaacccggaggcgtggatgtggtaccacaagtacgtcggccaggagcggtgccccatcgtggacacctggtggcagacggaaaccggttgcgcgatgatcgcgcctctgccaggcattatcaccaccaagccgggttctgccaccaagcccgtgcccggcatctccgtcgatatccttgacgacgacggcaatccggtgccgccggggcatggcggaaatctcgtcatcaccaagccctggccgtccatgctgcgcacggtgtggggcgatgacgagcgcttccgcaagacgtacttcgagaagttcgagggcatctacctgcctggggacggcgcgtaccgagatcaggatggctactactggattgtcggacggctggacgacgtgatcaacgtgtcgggccaccgcattggcactgcggaagtggagagcgcgctggtggctcatcccgctgtcgccgaggcggccgtgatcgggcgcgcccacgaagtcaaggggcaggccatcaccgcgtttgtcatcctcaaagagggccacaccggttcggacgatctcgtctcggaactgaagcaattcgtcgtcgagcaaatcggcgccatggcgcggccggaggagatcatcttcacggccgatctgcccaagacgcgcagcggcaagattatgcgccgcctgttgcgcgacatcgcggaaggccgtgtggtcggcgacaccaccaccctggccgatccggccgtcgtggagcaactgaaatcgcagtacaaggatcaggaatga

SEQ ID NO: 18 - protein, 112 aa, Alicyclobacillus acidocaldarius
MRRTASTDPRRPQGLARTKFTSINKRRNRLMQLDMVKAIYDIAVALLLGLAAVGSGVGDGMVMSKYVEGVARQPEARGSIFGSALLGVALVEAFPVIALAFGIIILFTKGAF

SEQ ID NO: 19 - DNA, 339 bp, Alicyclobacillus acidocaldarius
ttgaggcggacagccagcactgaccctcggcgtccgcaagggcttgcgcgaacgaagtttacgtccatcaacaaaaggaggaacagactgatgcaactcgacatggtcaaagcgatttacgacattgcggtggcgctcctgctcggcttggcggccgtcggttccggcgtcggcgacggcatggtcatgagcaagtacgtcgaaggcgtcgctcgccagcctgaagcgcgcggttccatcttcggcagcgcgctccttggtgtcgcgttggtcgaggccttcccggtcatcgcgctggcattcggtatcatcatcctcttcacgaagggcgcgttctga

SEQ ID NO: 20 - protein, 47 aa, Pasteuria ramosa
RYLSGITRQPEAASQLLTSMFIGIALVEALPIIAVALGIIKLFSIGS

SEQ ID NO: 21 - protein, 42 aa, Oceanobacillus iheyensis HTE831
KTVEGIARQPELRGALQGTMFIGVALVEAIPIIAAVIAFMVM

SEQ ID NO: 22 - protein, 45 aa, Desulfitobacterium hafniense Y51
KTVEGIARQPEAKGALQSTMFIGVGLIEALPLLTWVLALLLMFTK

SEQ ID NO: 23 - protein, 42 aa, Bacillus sp. B14905
KTVEGIARQPEARGVLQTTMFIGVALVEALPIIAVVVAFIVM

SEQ ID NO: 24 - protein, 43 aa, Thermosinus carboxydivorans Nor1
KAIEGMARQPEAKGTILVNMLISVGLIESIPIIAAVIAIVLVF

SEQ ID NO: 25 - protein, 112 aa, Artificial
  Substituion in SEQ ID NO 18
MRRTASTDPRRPQGLARTKFTSINKKRNRLMQLDMVKAIYDIAVALLLGLAAVGSGVGDGMVMSKYVEGVARQPEARGSIFGSALLGVALVEAFPVIALAFGIIILFTKGAF

SEQ ID NO: 26 - protein, 112 aa, Artificial
  Substituion in SEQ ID NO 18
MRRTASTDPRRPQGLARTKFTSINKRRNRLMQLDMVKAIYDIAVALLLGLAAIGSGVGDGMVMSKYVEGVARQPEARGSIFGSALLGVALVEAFPVIALAFGIIILFTKGAF

SEQ ID NO: 27 - protein, 112 aa, Artificial
  Substituion in SEQ ID NO 18
MRRTASTDPRRPQGLARTKFTSINKRRNRLMQLDMVKAIYDIAVALLLGLAAVGSGVGDGMVMSKYVEGVARQPEARGSIFGSALLGVALVEAFPVIALAFGIIILFTRGAF

SEQ ID NO: 28 - protein, 112 aa, Artificial
  Substituion in SEQ ID NO 18
MRKTASTDPRRPQGLARTKFTSINKRRNRLMQLDMVKAIYDIAVALLLGLAAVGSGVGDGMVMSKYVEGVARQPEARGSIFGSALLGVALVEAFPVIALAFGIIILFTKGAF

SEQ ID NO: 29 - protein, 112 aa, Artificial
  Substituion in SEQ ID NO 18
MRRTASTDPRRPQGLARTKFTSINKRRNRLMQLEMVKAIYDIAVALLLGLAAVGSGVGDGMVMSKYVEGVARQPEARGSIFGSALLGVALVEAFPVIALAFGIIILFTKGAF

SEQ ID NO: 30 - DNA, 339 bp, Artificial
  Substituion in SEQ ID NO 19
ttgaggcggacagccagcactgaccctcggcgtccgcaagggcttgcgcgaacgaagtttacgtccatcaacaaaaaaaggaacagactgatgcaactcgacatggtcaaagcgatttacgacattgcggtggcgctcctgctcggcttggcggccgtcggttccggcgtcggcgacggcatggtcatgagcaagtacgtcgaaggcgtcgctcgccagcctgaagcgcgcggttccatcttcggcagcgcgctccttggtgtcgcgttggtcgaggccttcccggtcatcgcgctggcattcggtatcatcatcctcttcacgaagggcgcgttctga

SEQ ID NO: 31 - DNA, 339 bp, Artificial
  Substituion in SEQ ID NO 19
ttgaggcggacagccagcactgaccctcggcgtccgcaagggcttgcgcgaacgaagtttacgtccatcaacaaaaggaggaacagactgatgcaactcgacatggtcaaagcgatttacgacattgcggtggcgctcctgctcggcttggcggccattggttccggcgtcggcgacggcatggtcatgagcaagtacgtcgaaggcgtcgctcgccagcctgaagcgcgcggttccatcttcggcagcgcgctccttggtgtcgcgttggtcgaggccttcccggtcatcgcgctggcattcggtatcatcatcctcttcacgaagggcgcgttctga

SEQ ID NO: 32 - DNA, 339 bp, Artificial
  Substituion in SEQ ID NO 19
ttgaggcggacagccagcactgaccctcggcgtccgcaagggcttgcgcgaacgaagtttacgtccatcaacaaaaggaggaacagactgatgcaactcgacatggtcaaagcgatttacgacattgcggtggcgctcctgctcggcttggcggccgtcggttccggcgtcggcgacggcatggtcatgagcaagtacgtcgaaggcgtcgctcgccagcctgaagcgcgcggttccatcttcggcagcgcgctccttggtgtcgcgttggtcgaggccttcccggtcatcgcgctggcattcggtatcatcatcctcttcacgcgtggcgcgttctga

SEQ ID NO: 33 - DNA, 339 bp, Artificial
  Substituion in SEQ ID NO 19
ttgaggaaaacagccagcactgaccctcggcgtccgcaagggcttgcgcgaacgaagtttacgtccatcaacaaaaggaggaacagactgatgcaactcgacatggtcaaagcgatttacgacattgcggtggcgctcctgctcggcttggcggccgtcggttccggcgtcggcgacggcatggtcatgagcaagtacgtcgaaggcgtcgctcgccagcctgaagcgcgcggttccatcttcggcagcgcgctccttggtgtcgcgttggtcgaggccttcccggtcatcgcgctggcattcggtatcatcatcctcttcacgaagggcgcgttctga

SEQ ID NO: 34 - DNA, 339 bp, Artificial
  Substituion in SEQ ID NO 19
ttgaggcggacagccagcactgaccctcggcgtccgcaagggcttgcgcgaacgaagtttacgtccatcaacaaaaggaggaacagactgatgcaactcgaaatggtcaaagcgatttacgacattgcggtggcgctcctgctcggcttggcggccgtcggttccggcgtcggcgacggcatggtcatgagcaagtacgtcgaaggcgtcgctcgccagcctgaagcgcgcggttccatcttcggcagcgcgctccttggtgtcgcgttggtcgaggccttcccggtcatcgcgctggcattcggtatcatcatcctcttcacgaagggcgcgttctga

SEQ ID NO: 35 - protein, 447 aa, Alicyclobacillus acidocaldarius
MCAPCSNRKMNVNRGVLSHAALDERSCAGLTTLLQQVDPDVASAMQAELRRQQRNIELIASENFVSEAVLEALGSVLTNKYAEGYPGRRYYGGCEYVDVVERIAIDRVKELFGAEYANVQPHSGSQANMTVYFSVLKPGDTVLGMNLAHGGHLTHGSPVNFSGQLYKFVSYGVHPETHLIDYDEVLKVAKEHRPKMIVAGASAYPRVIDFKRMREIADEVGAYLMVDMAHIAGLIAAGLHPSPVPYAHFVTSTTHKTLRGPRGGFILCQKDVAKLIDKTNFPGVQGGPLMHVIAAKAVAFGEALKPEFKAYQEQIVKNAKALAEALKGYGFRLVSGGTDNHLMLIDVRSAGLTGKEAERRLDEIGITVNKNAIPFDPESPMVTSGIRVGTPAATSRGMDEGAMQEIAEIFKLVLLGDFSDEVKREARARVDSLTDRFPLYPTLSYVE

SEQ ID NO: 36 - DNA, 1344 bp, Alicyclobacillus acidocaldarius
ttgtgcgccccgtgttcgaaccgtaagatgaatgtgaatcgcggcgtcctctcgcatgcggcgctggatgaaaggagttgcgcaggattgaccacccttctgcagcaggttgacccggatgtcgcgtctgcgatgcaggccgagctccgtcggcagcagcggaacatcgaactcatcgcttcagaaaactttgtcagcgaggccgttctcgaggcccttggatccgtcctgacgaacaaatacgccgaaggctacccaggccggcgctattacggcggctgcgagtacgtcgacgtggtcgagcgcattgccatcgatcgcgtcaaggagctgttcggcgccgagtacgcgaacgtccagccgcacagtggttcgcaggcgaacatgacggtctacttcagcgtcctcaagccgggcgacacggtgctcggcatgaatctggcgcacggcggccacttgacgcatgggagccccgtgaacttctccgggcagctttacaagttcgtctcgtacggcgtccacccggagacccatctcatcgattacgacgaggtgctcaaggtcgcgaaggaacatcggccgaagatgatcgtcgccggcgcgagcgcgtacccgcgcgtcatcgacttcaaacgcatgcgggagattgcggacgaggtcggcgcgtatctgatggtggacatggcgcacattgcgggcctcattgccgcggggcttcacccgtcccccgtgccgtacgcgcacttcgtgacgtccacgacgcacaagacgcttcggggtccgcgcggcgggttcatcctctgtcagaaggacgtcgccaagctcatcgacaagacgaatttccccggcgtccagggcggtcccctcatgcacgtgattgcagcgaaggccgtcgccttcggggaagctttgaaacccgaattcaaggcgtaccaggagcagattgtgaagaacgcgaaggcgctcgccgaagcgctcaaagggtacgggttccgcctcgtgtccggcggcaccgacaaccacctgatgctcatcgacgtccgcagcgcggggctgaccggcaaagaagccgagcggaggctggacgagatcggcatcacggtcaacaagaacgccatcccattcgatccggagagcccgatggtgacgagcggcatccgcgtcggcacgcctgccgcgacttcgcgcggcatggacgagggcgcgatgcaggagattgccgagatcttcaagctcgtgctcctcggcgacttcagcgacgaggtgaagcgcgaggctcgcgctcgcgtcgacagcttgacggaccggtttccgctctatccgactttgtcctacgtcgaatga

SEQ ID NO: 37 - protein, 416 aa, Carboxydothermus hydrogenoformans Z-2901
LNLRLKDVDPEIFEAMEKELSRQREKIELIASENFVSRAVMEAMGSHLTNKYAEGLPGKRYYGGCEYVDVVENLARERAKKLFGAEHVNVQPHSGAQANMAAYMAFLEPGDTVLGMNLAHGGHLTHGSPVNFSGKLYNFVSYGVEPDTEKINYEKVFELAYKHKPKMIVAGASAYPRVIDFKHLKEIADEVGAYLMVDMAHIAGLVAAGLHPSPIPYADVVTTTTHKTLRGPRGGVIFCKAEHAAKIDKTVFPGVQGGPLMHVIAAKAVAFKEALSPEFREYQQQVVNNAKALAEELKKQGLRLVSGGTDNHLMLVDVRPVGLTGKRAEQLLDEIGVTVNKNAIPYDPESPNVTSGIRIGTPAVTTRGMKEGEMAEIAEIIALVLKNPENEDKHREAARKVRDLLNRFPLYDKLPY

SEQ ID NO: 38 - protein, 410 aa, Bacillus halodurans C-125
LQSKDPKVFEAVQQELGRQRDKIELIASENFVSEAVMEAQSSVLTNKYAEGYPGRRYYGGCEYVDIVEDLARDRAKEIFGGEHVNVQPHSGAQANMAVYFTILEHGDTVLGMNLSHGGHLTHGSPVNFSGIQYNFVEYGVDKESQRIDYEEVRRLAKEHQPKMIVAGASAYPREIDFAKFREIADEVGAYLMVDMAHIAGLVAAGLHQNPVPHSHFVTTTTHKTLRGPRGGMIICNEEFAKQIDKSIFPGIQGGPLMHVIAAKAVAFGEALQPEFKSYGEAIIRNAKRLGEKLTSEGIDLVSGGTDNHLLLLDLRSLGLTGKVAEKALDDVGITTNKNTIPFDPESPFVTSGIRIGTAAVTSRGLDEEAMDEIGATIALTLKNVDNEEKMNEARERVDALTAKFPMYPNL

SEQ ID NO: 39 - protein, 410 aa, Exiguobacterium sibiricum 255-15
TYLKQQDEELFSAMRKELKRQRDNIELIASENFVSQAVMEAQGSVLTNKYAEGYPGRRYYGGCEFVDLAENLARDRAKAIFGAEHVNVQPHSGAQANMAVYFTILNQGDTVLGMNLSHGGHLTHGSPVNFSGVQYNFVEYGVDPETEMIDYDVVAKLAEEHKPKLIVAGASAYPRVIDFKRFREIADSVGAYLMVDMAHIAGLVAAGLHPNPVEHAHFVTTTTHKTLRGPRGGMILCKEEHAKAIDKSIFPGIQGGPLMHVIAAKAVAFAEALAPEFKDYIEQVVANAKVLGEELTARGLRIVSGGTDNHLLLVDLQPLGITGKLAEHALDEAGITVNKNTIPFDPASPFVTSGIRIGTAAMTSRGFKEAEMKQIAELIELVLKNPEDQETLTSAHKQVLALTGRFPLYP

SEQ ID NO: 40 - protein, 407 aa, Geobacillus thermodenitrificans NG80-2
LPQQDPQVFATIEQERKRQHAKIELIASENFVSRAVMEAQGSVMTNKYAEGYPGRRYYGGCEYVDVVEDLARERAKQLFGAEHANVQPHSGAQANMAVYFTVLKPGDTVLGMNLSHGGHLTHGSPVNFSGVQYNFVEYGVDPETHVIDYDDVREKARLHRPKLIVAGASAYPRVIDFAKFREIADEVGAYLMVDMAHIAGLVAAGLHPNPVPYAHFVTTTTHKTLRGPRGGMILCQEQFAKQIDKSIFPGIQGGPLMHVIAAKAVALGEALQDDFKVYAKRIIDNAQRLAAALQKEGFTLVSGGTDNHLLLVDLRPQQLTGKTAEKVLDEVGITVNKNTIPYDPESPFVTSGIRIGTAAVTTRGFGLEEMDEIASLIGLVLKNIDNEQALEEARQRVVALTEKFPLY

SEQ ID NO: 41 - protein, 407 aa, Geobacillus kaustophilus HTA426
LPQQDPQVFAAIEQERKRQHAKIELIASENFVSRAVMEAQGSVLTNKYAEGYPGRRYYGGCEYVDIVEDLARERAKQLFGAEHVNVQPHSGAQANMAVYFTVLEHGDTVLGMNLSHGGHLTHGSPVNFSGIQYNFVEYGVDPETHVIDYDDVREKARLHRPKLIVAGASAYPRIIDFAKFREIADEVGAYLMVDMAHIAGLVAAGVHPNPVPYAHFVTTTTHKTLRGPRGGMILCQEQFAKQIDKAIFPGIQGGPLMHVIAAKAVALGEALQDDFKVYAKRVVENAKRLAAALQNEGFTLISGGTDNHLLLVDLRPQQLTGKTAEKVLDEVGITVNKNTIPYDPESPFVTSGIRIGTAAVTTRGFGLEEMDEIAAIIGLVLKNVGSEQALEEARQRVAALTEKFPLY

SEQ ID NO: 42 - protein, 447 aa, Artificial
  Substituion in SEQ ID NO 35
MCAPCSNRKMNVNRGVLSHAALDERSCAGLTTLLQQVDPDVASAMQAELRRQQRNIELIASENFVSEAVLEALGSVLTNKYAEGYPGRRYYGGCEYVDVVERIAIDRVKELFGAEYANVQPHSGSQANMTVYFSVLKPGDTVLGMNLAHGGHLTHGSPVNFSGQLYKFVSYGVHPETHLIDYDEVLKVAKEHRPKMIVAGASAYPRVIDFKRMREIADEVGAYLMVDMAHIAGLIAAGLHPSPVPYAHFVTSTTHKTLRGPRGGFILCQKDVAKIIDKTNFPGVQGGPLMHVIAAKAVAFGEALKPEFKAYQEQIVKNAKALAEALKGYGFRLVSGGTDNHLMLIDVRSAGLTGKEAERRLDEIGITVNKNAIPFDPESPMVTSGIRVGTPAATSRGMDEGAMQEIAEIFKLVLLGDFSDEVKREARARVDSLTDRFPLYPTLSYVE

SEQ ID NO: 43 - protein, 447 aa, Artificial
  Substituion in SEQ ID NO 35
MCAPCSNRRMNVNRGVLSHAALDERSCAGLTTLLQQVDPDVASAMQAELRRQQRNIELIASENFVSEAVLEALGSVLTNKYAEGYPGRRYYGGCEYVDVVERIAIDRVKELFGAEYANVQPHSGSQANMTVYFSVLKPGDTVLGMNLAHGGHLTHGSPVNFSGQLYKFVSYGVHPETHLIDYDEVLKVAKEHRPKMIVAGASAYPRVIDFKRMREIADEVGAYLMVDMAHIAGLIAAGLHPSPVPYAHFVTSTTHKTLRGPRGGFILCQKDVAKLIDKTNFPGVQGGPLMHVIAAKAVAFGEALKPEFKAYQEQIVKNAKALAEALKGYGFRLVSGGTDNHLMLIDVRSAGLTGKEAERRLDEIGITVNKNAIPFDPESPMVTSGIRVGTPAATSRGMDEGAMQEIAEIFKLVLLGDFSDEVKREARARVDSLTDRFPLYPTLSYVE

SEQ ID NO: 44 - protein, 447 aa, Artificial
  Substituion in SEQ ID NO 35
MCAPCSNRKMNVNRGVLSHAALDERSCAGLTTLLQQVDPDVASAMQAELRRQQRNIELIASENFVSEAVLEALGSVLTNKYAEGYPGRRYYGGCEYVDVVERIAIDRVKDLFGAEYANVQPHSGSQANMTVYFSVLKPGDTVLGMNLAHGGHLTHGSPVNFSGQLYKFVSYGVHPETHLIDYDEVLKVAKEHRPKMIVAGASAYPRVIDFKRMREIADEVGAYLMVDMAHIAGLIAAGLHPSPVPYAHFVTSTTHKTLRGPRGGFILCQKDVAKLIDKTNFPGVQGGPLMHVIAAKAVAFGEALKPEFKAYQEQIVKNAKALAEALKGYGFRLVSGGTDNHLMLIDVRSAGLTGKEAERRLDEIGITVNKNAIPFDPESPMVTSGIRVGTPAATSRGMDEGAMQEIAEIFKLVLLGDFSDEVKREARARVDSLTDRFPLYPTLSYVE

SEQ ID NO: 45 - protein, 447 aa, Artificial
  Substituion in SEQ ID NO 35
MCAPCSNRKMQVNRGVLSHAALDERSCAGLTTLLQQVDPDVASAMQAELRRQQRNIELIASENFVSEAVLEALGSVLTNKYAEGYPGRRYYGGCEYVDVVERIAIDRVKELFGAEYANVQPHSGSQANMTVYFSVLKPGDTVLGMNLAHGGHLTHGSPVNFSGQLYKFVSYGVHPETHLIDYDEVLKVAKEHRPKMIVAGASAYPRVIDFKRMREIADEVGAYLMVDMAHIAGLIAAGLHPSPVPYAHFVTSTTHKTLRGPRGGFILCQKDVAKLIDKTNFPGVQGGPLMHVIAAKAVAFGEALKPEFKAYQEQIVKNAKALAEALKGYGFRLVSGGTDNHLMLIDVRSAGLTGKEAERRLDEIGITVNKNAIPFDPESPMVTSGIRVGTPAATSRGMDEGAMQEIAEIFKLVLLGDFSDEVKREARARVDSLTDRFPLYPTLSYVE

SEQ ID NO: 46 - protein, 447 aa, Artificial
  Substituion in SEQ ID NO 35
MCAPCSNRKMNVNRGVLSHAALEERSCAGLTTLLQQVDPDVASAMQAELRRQQRNIELIASENFVSEAVLEALGSVLTNKYAEGYPGRRYYGGCEYVDVVERIAIDRVKELFGAEYANVQPHSGSQANMTVYFSVLKPGDTVLGMNLAHGGHLTHGSPVNFSGQLYKFVSYGVHPETHLIDYDEVLKVAKEHRPKMIVAGASAYPRVIDFKRMREIADEVGAYLMVDMAHIAGLIAAGLHPSPVPYAHFVTSTTHKTLRGPRGGFILCQKDVAKLIDKTNFPGVQGGPLMHVIAAKAVAFGEALKPEFKAYQEQIVKNAKALAEALKGYGFRLVSGGTDNHLMLIDVRSAGLTGKEAERRLDEIGITVNKNAIPFDPESPMVTSGIRVGTPAATSRGMDEGAMQEIAEIFKLVLLGDFSDEVKREARARVDSLTDRFPLYPTLSYVE

SEQ ID NO: 47 - DNA, 1344 bp, Artificial
  Substituion in SEQ ID NO 36
ttgtgcgccccgtgttcgaaccgtaagatgaatgtgaatcgcggcgtcctctcgcatgcggcgctggatgaaaggagttgcgcaggattgaccacccttctgcagcaggttgacccggatgtcgcgtctgcgatgcaggccgagctccgtcggcagcagcggaacatcgaactcatcgcttcagaaaactttgtcagcgaggccgttctcgaggcccttggatccgtcctgacgaacaaatacgccgaaggctacccaggccggcgctattacggcggctgcgagtacgtcgacgtggtcgagcgcattgccatcgatcgcgtcaaggagctgttcggcgccgagtacgcgaacgtccagccgcacagtggttcgcaggcgaacatgacggtctacttcagcgtcctcaagccgggcgacacggtgctcggcatgaatctggcgcacggcggccacttgacgcatgggagccccgtgaacttctccgggcagctttacaagttcgtctcgtacggcgtccacccggagacccatctcatcgattacgacgaggtgctcaaggtcgcgaaggaacatcggccgaagatgatcgtcgccggcgcgagcgcgtacccgcgcgtcatcgacttcaaacgcatgcgggagattgcggacgaggtcggcgcgtatctgatggtggacatggcgcacattgcgggcctcattgccgcggggcttcacccgtcccccgtgccgtacgcgcacttcgtgacgtccacgacgcacaagacgcttcggggtccgcgcggcgggttcatcctctgtcagaaggacgtcgccaagattatcgacaagacgaatttccccggcgtccagggcggtcccctcatgcacgtgattgcagcgaaggccgtcgccttcggggaagctttgaaacccgaattcaaggcgtaccaggagcagattgtgaagaacgcgaaggcgctcgccgaagcgctcaaagggtacgggttccgcctcgtgtccggcggcaccgacaaccacctgatgctcatcgacgtccgcagcgcggggctgaccggcaaagaagccgagcggaggctggacgagatcggcatcacggtcaacaagaacgccatcccattcgatccggagagcccgatggtgacgagcggcatccgcgtcggcacgcctgccgcgacttcgcgcggcatggacgagggcgcgatgcaggagattgccgagatcttcaagctcgtgctcctcggcgacttcagcgacgaggtgaagcgcgaggctcgcgctcgcgtcgacagcttgacggaccggtttccgctctatccgactttgtcctacgtcgaatga

SEQ ID NO: 48 - DNA, 1344 bp, Artificial
  Substituion in SEQ ID NO 36
ttgtgcgccccgtgttcgaaccgtcgtatgaatgtgaatcgcggcgtcctctcgcatgcggcgctggatgaaaggagttgcgcaggattgaccacccttctgcagcaggttgacccggatgtcgcgtctgcgatgcaggccgagctccgtcggcagcagcggaacatcgaactcatcgcttcagaaaactttgtcagcgaggccgttctcgaggcccttggatccgtcctgacgaacaaatacgccgaaggctacccaggccggcgctattacggcggctgcgagtacgtcgacgtggtcgagcgcattgccatcgatcgcgtcaaggagctgttcggcgccgagtacgcgaacgtccagccgcacagtggttcgcaggcgaacatgacggtctacttcagcgtcctcaagccgggcgacacggtgctcggcatgaatctggcgcacggcggccacttgacgcatgggagccccgtgaacttctccgggcagctttacaagttcgtctcgtacggcgtccacccggagacccatctcatcgattacgacgaggtgctcaaggtcgcgaaggaacatcggccgaagatgatcgtcgccggcgcgagcgcgtacccgcgcgtcatcgacttcaaacgcatgcgggagattgcggacgaggtcggcgcgtatctgatggtggacatggcgcacattgcgggcctcattgccgcggggcttcacccgtcccccgtgccgtacgcgcacttcgtgacgtccacgacgcacaagacgcttcggggtccgcgcggcgggttcatcctctgtcagaaggacgtcgccaagctcatcgacaagacgaatttccccggcgtccagggcggtcccctcatgcacgtgattgcagcgaaggccgtcgccttcggggaagctttgaaacccgaattcaaggcgtaccaggagcagattgtgaagaacgcgaaggcgctcgccgaagcgctcaaagggtacgggttccgcctcgtgtccggcggcaccgacaaccacctgatgctcatcgacgtccgcagcgcggggctgaccggcaaagaagccgagcggaggctggacgagatcggcatcacggtcaacaagaacgccatcccattcgatccggagagcccgatggtgacgagcggcatccgcgtcggcacgcctgccgcgacttcgcgcggcatggacgagggcgcgatgcaggagattgccgagatcttcaagctcgtgctcctcggcgacttcagcgacgaggtgaagcgcgaggctcgcgctcgcgtcgacagcttgacggaccggtttccgctctatccgactttgtcctacgtcgaatga

SEQ ID NO: 49 - DNA, 1344 bp, Artificial
  Substituion in SEQ ID NO 36
ttgtgcgccccgtgttcgaaccgtaagatgaatgtgaatcgcggcgtcctctcgcatgcggcgctggatgaaaggagttgcgcaggattgaccacccttctgcagcaggttgacccggatgtcgcgtctgcgatgcaggccgagctccgtcggcagcagcggaacatcgaactcatcgcttcagaaaactttgtcagcgaggccgttctcgaggcccttggatccgtcctgacgaacaaatacgccgaaggctacccaggccggcgctattacggcggctgcgagtacgtcgacgtggtcgagcgcattgccatcgatcgcgtcaaggatctgttcggcgccgagtacgcgaacgtccagccgcacagtggttcgcaggcgaacatgacggtctacttcagcgtcctcaagccgggcgacacggtgctcggcatgaatctggcgcacggcggccacttgacgcatgggagccccgtgaacttctccgggcagctttacaagttcgtctcgtacggcgtccacccggagacccatctcatcgattacgacgaggtgctcaaggtcgcgaaggaacatcggccgaagatgatcgtcgccggcgcgagcgcgtacccgcgcgtcatcgacttcaaacgcatgcgggagattgcggacgaggtcggcgcgtatctgatggtggacatggcgcacattgcgggcctcattgccgcggggcttcacccgtcccccgtgccgtacgcgcacttcgtgacgtccacgacgcacaagacgcttcggggtccgcgcggcgggttcatcctctgtcagaaggacgtcgccaagctcatcgacaagacgaatttccccggcgtccagggcggtcccctcatgcacgtgattgcagcgaaggccgtcgccttcggggaagctttgaaacccgaattcaaggcgtaccaggagcagattgtgaagaacgcgaaggcgctcgccgaagcgctcaaagggtacgggttccgcctcgtgtccggcggcaccgacaaccacctgatgctcatcgacgtccgcagcgcggggctgaccggcaaagaagccgagcggaggctggacgagatcggcatcacggtcaacaagaacgccatcccattcgatccggagagcccgatggtgacgagcggcatccgcgtcggcacgcctgccgcgacttcgcgcggcatggacgagggcgcgatgcaggagattgccgagatcttcaagctcgtgctcctcggcgacttcagcgacgaggtgaagcgcgaggctcgcgctcgcgtcgacagcttgacggaccggtttccgctctatccgactttgtcctacgtcgaatga

SEQ ID NO: 50 - DNA, 1344 bp, Artificial
  Substituion in SEQ ID NO 36
ttgtgcgccccgtgttcgaaccgtaagatgcaagtgaatcgcggcgtcctctcgcatgcggcgctggatgaaaggagttgcgcaggattgaccacccttctgcagcaggttgacccggatgtcgcgtctgcgatgcaggccgagctccgtcggcagcagcggaacatcgaactcatcgcttcagaaaactttgtcagcgaggccgttctcgaggcccttggatccgtcctgacgaacaaatacgccgaaggctacccaggccggcgctattacggcggctgcgagtacgtcgacgtggtcgagcgcattgccatcgatcgcgtcaaggagctgttcggcgccgagtacgcgaacgtccagccgcacagtggttcgcaggcgaacatgacggtctacttcagcgtcctcaagccgggcgacacggtgctcggcatgaatctggcgcacggcggccacttgacgcatgggagccccgtgaacttctccgggcagctttacaagttcgtctcgtacggcgtccacccggagacccatctcatcgattacgacgaggtgctcaaggtcgcgaaggaacatcggccgaagatgatcgtcgccggcgcgagcgcgtacccgcgcgtcatcgacttcaaacgcatgcgggagattgcggacgaggtcggcgcgtatctgatggtggacatggcgcacattgcgggcctcattgccgcggggcttcacccgtcccccgtgccgtacgcgcacttcgtgacgtccacgacgcacaagacgcttcggggtccgcgcggcgggttcatcctctgtcagaaggacgtcgccaagctcatcgacaagacgaatttccccggcgtccagggcggtcccctcatgcacgtgattgcagcgaaggccgtcgccttcggggaagctttgaaacccgaattcaaggcgtaccaggagcagattgtgaagaacgcgaaggcgctcgccgaagcgctcaaagggtacgggttccgcctcgtgtccggcggcaccgacaaccacctgatgctcatcgacgtccgcagcgcggggctgaccggcaaagaagccgagcggaggctggacgagatcggcatcacggtcaacaagaacgccatcccattcgatccggagagcccgatggtgacgagcggcatccgcgtcggcacgcctgccgcgacttcgcgcggcatggacgagggcgcgatgcaggagattgccgagatcttcaagctcgtgctcctcggcgacttcagcgacgaggtgaagcgcgaggctcgcgctcgcgtcgacagcttgacggaccggtttccgctctatccgactttgtcctacgtcgaatga

SEQ ID NO: 51 - DNA, 1344 bp, Artificial
  Substituion in SEQ ID NO 36
ttgtgcgccccgtgttcgaaccgtaagatgaatgtgaatcgcggcgtcctctcgcatgcggcgctggaagaaaggagttgcgcaggattgaccacccttctgcagcaggttgacccggatgtcgcgtctgcgatgcaggccgagctccgtcggcagcagcggaacatcgaactcatcgcttcagaaaactttgtcagcgaggccgttctcgaggcccttggatccgtcctgacgaacaaatacgccgaaggctacccaggccggcgctattacggcggctgcgagtacgtcgacgtggtcgagcgcattgccatcgatcgcgtcaaggagctgttcggcgccgagtacgcgaacgtccagccgcacagtggttcgcaggcgaacatgacggtctacttcagcgtcctcaagccgggcgacacggtgctcggcatgaatctggcgcacggcggccacttgacgcatgggagccccgtgaacttctccgggcagctttacaagttcgtctcgtacggcgtccacccggagacccatctcatcgattacgacgaggtgctcaaggtcgcgaaggaacatcggccgaagatgatcgtcgccggcgcgagcgcgtacccgcgcgtcatcgacttcaaacgcatgcgggagattgcggacgaggtcggcgcgtatctgatggtggacatggcgcacattgcgggcctcattgccgcggggcttcacccgtcccccgtgccgtacgcgcacttcgtgacgtccacgacgcacaagacgcttcggggtccgcgcggcgggttcatcctctgtcagaaggacgtcgccaagctcatcgacaagacgaatttccccggcgtccagggcggtcccctcatgcacgtgattgcagcgaaggccgtcgccttcggggaagctttgaaacccgaattcaaggcgtaccaggagcagattgtgaagaacgcgaaggcgctcgccgaagcgctcaaagggtacgggttccgcctcgtgtccggcggcaccgacaaccacctgatgctcatcgacgtccgcagcgcggggctgaccggcaaagaagccgagcggaggctggacgagatcggcatcacggtcaacaagaacgccatcccattcgatccggagagcccgatggtgacgagcggcatccgcgtcggcacgcctgccgcgacttcgcgcggcatggacgagggcgcgatgcaggagattgccgagatcttcaagctcgtgctcctcggcgacttcagcgacgaggtgaagcgcgaggctcgcgctcgcgtcgacagcttgacggaccggtttccgctctatccgactttgtcctacgtcgaatga

SEQ ID NO: 52 - protein, 261 aa, Alicyclobacillus acidocaldarius
MRNLTETFTTYRVEDHVAVLTLNRPQALNALSREVLSEIGAHLAMLDLKDVRVLVIRGEGRVFCAGADIGQMQHMSAVEAESMARLGQRVFQAIEQLPIPVIALIHGGAFGGGLELALACDFRIAAAGAVVGLPEVTLGVNPSFGGTYRLPRAIGFARALSMMLLGERIPVEKALEYGLVNEVVAPDELEARGMDLARKLASQSSAAMAAIKRSAHHGFGQDPARAQAYEAAQFGLCFASGDAHEGMAAFKEKRQARFHED

SEQ ID NO: 53 - DNA, 786 bp, Alicyclobacillus acidocaldarius
gtgaggaatttgacagagacgttcaccacgtaccgcgtggaggatcatgtggcggttttgacgctcaatcgtccgcaggctttgaacgcgctttctcgagaagtgctgtcggaaatcggtgcgcatcttgcgatgttggatctcaaggacgtccgcgttctcgtcatccgcggcgagggccgggtgttctgcgcgggcgcggacatcggccagatgcagcacatgagcgccgtggaggccgagagcatggcgcgccttgggcagcgcgtgttccaggccatcgaacagctgcccattccggtgattgcgctgattcacggcggggcgtttggcggggggcttgaactcgcgctcgcgtgcgattttcggattgcggccgcaggcgccgtcgtcgggctgcccgaggtgacgctgggggtcaacccgagtttcggcgggacgtaccggctcccgcgcgccatcgggttcgcgcgcgcgctctcgatgatgcttctgggggagcggatcccggtcgagaaggccctggagtacgggctcgtgaacgaggtggtggcgcctgacgagctcgaggcgaggggcatggatctcgcgcgaaaactcgcgagccagtcgagcgccgcgatggcggccatcaagcggtcggcccaccacgggtttgggcaggatccagctcgcgcgcaggcgtatgaggcggcgcagttcggcctgtgctttgcttctggggacgcgcacgagggcatggcggccttcaaggagaagcgccaggcgaggtttcacgaggactga

SEQ ID NO: 54 - protein, 245 aa, Porphyromonas gingivalis W83
KDGITTLTINKPETLNALSSEVLSELKSAIAVIATEKPRVLIITGSGKAFVAGADIAEMQHLSAAEGKAFGGLGAEVFRRIEELPFPVIAAINGFALGGGCELAMACDIRIASAKAKFGQPEVGLGITPGFSGTQRLPRLVAPGIAKELIYTGRIIDAEEALRIGLVNRVTTPEELLPATMETAQLIASRSASAVSASKEAINRGTEMHIAEGIALEQNLFGLCFATADQKEGMAAFLEKRKPAF

SEQ ID NO: 55 - protein, 250 aa, Thermosinus carboxydivorans Nor1
YEFDGGIGIITINRPKALNALNGATMRELNELLDVIAQDPSVKVVIITGSGEKAFVAGADITEMQSMSAIEGRNWGKLGQAVFDKLENLPQPVIAAVNGFALGGGCELAMACDIRIASDKAKFGQPEVTLGITPGFAGTQRLPRLVGKGRAKELLFTGDMIDAAEAYRIGLVNKVVPPEELMAAAKAMAQKIMSRAPMAVQLCKAAVNEGMDMDLQSAVAYEAEVFGLCFATADQKEGMAAFVEKRKANF

SEQ ID NO: 56 - protein, 250 aa, Carboxydothermus hydrogenoformans Z-2901
FEKKDQVGIITINRPQVLNALNSEVLEELDSLLDKIAEDESITVVILTGAGEKSFVAGADISQMRNFTPRQARYFAKLGQKVLSKLERIPQPVIAAVNGFALGGGCEIAMACDFRIASTKAKFGQPEVGLGVTAGFGGTQRLPRLVGKGMAAELLYTGEMIDAQEALRIGLVNRVVEPEELMPTALEIAQKIAAKAKLAVFYSKAALNEGLNMDLERALAYEAEMFALCFTTSDQKEGMDAFLNKRKPEF

SEQ ID NO: 57 - protein, 247 aa, Syntrophomonas wolfei subsp. wolfei str. Goettingen
EEKLAVLYINRPKAMNALNKDTLLEIKDAVTAVNDDPAVELLIITGSGDKSFVAGADIAFMQNLSAMEAREFGALGQKVFRLIEAMEKPVIAAVNGFALGGGCELAMCCDFRIAASNAKFGQPEVGLGITPGFGGTQRLPRLVGPGMAKQLLYTADVINADEAFRIGLVNKVVQPEELLPEVKKIAGRILSKGQLAVRLSKAAANEGMQTDIDRAMSIEADAFGLCFATQDQKEGMTAFLEKRKANF

SEQ ID NO: 58 - protein, 248 aa, Geobacter metallireducens GS-15
RHDDAIAVVSLARPESRNVLSRDLVLGLLSTFTSLKDDGRVKGIVVTGEGKSFCAGADISEMARMSPAEASSFAELGQRLMFAVERVGKPVVAAVNGHAFGGGLELALACDFIVAAESAVFAAPEVLLGVMPGFGGTQRLPRLIGKSRAKEMIFTGERINAAKAHSIGLVNRVVSDERLLAETVSLVKNICNRGLLSLRVAKEVIDAGAGIDLATACLMERDAFALCFSTDDQKEGMRAFMEKREPRF

SEQ ID NO: 59 - protein, 261 aa, Artificial
  Substituion in SEQ ID NO 52
MRNLTETFTTYRVEDHVAVLTLNRPQAINALSREVLSEIGAHLAMLDLKDVRVLVIRGEGRVFCAGADIGQMQHMSAVEAESMARLGQRVFQAIEQLPIPVIALIHGGAFGGGLELALACDFRIAAAGAVVGLPEVTLGVNPSFGGTYRLPRAIGFARALSMMLLGERIPVEKALEYGLVNEVVAPDELEARGMDLARKLASQSSAAMAAIKRSAHHGFGQDPARAQAYEAAQFGLCFASGDAHEGMAAFKEKRQARFHED

SEQ ID NO: 60 - protein, 261 aa, Artificial
  Substituion in SEQ ID NO 52
MRNLTETFTTYRVEDHVAVLTLNRPQALNALSREVLSEIGAHLAMLDLKDVRVLVIRGEGRVFCAGADIGQMQHMSAVEAESMARLGQRVFQAIEQLPIPVIALIHGGAFGGGLELALACDFRIAAAGAVVGLPEVTLGVNPSFGGTYRLPRAIGFARALSMMLLGERIPVDKALEYGLVNEVVAPDELEARGMDLARKLASQSSAAMAAIKRSAHHGFGQDPARAQAYEAAQFGLCFASGDAHEGMAAFKEKRQARFHED

SEQ ID NO: 61 - protein, 261 aa, Artificial
  Substituion in SEQ ID NO 52
MRNLTETFTTYRIEDHVAVLTLNRPQALNALSREVLSEIGAHLAMLDLKDVRVLVIRGEGRVFCAGADIGQMQHMSAVEAESMARLGQRVFQAIEQLPIPVIALIHGGAFGGGLELALACDFRIAAAGAVVGLPEVTLGVNPSFGGTYRLPRAIGFARALSMMLLGERIPVEKALEYGLVNEVVAPDELEARGMDLARKLASQSSAAMAAIKRSAHHGFGQDPARAQAYEAAQFGLCFASGDAHEGMAAFKEKRQARFHED

SEQ ID NO: 62 - protein, 261 aa, Artificial
  Substituion in SEQ ID NO 52
MRNLTETFTTYRVEDHVAVLTLNRPQALNALSREVLSEIGAHLAMLDLKDVRVLVIRGEGRVFCAGADIGQMQHMSAVEAESMARLGQRVFQAIEQLPIPVIALIHGGAFGGGLELALACDFRIAAAGAVVGLPEVTLGVNPSFGGTYRLPRAIGFARALSMMLLGERIPVEKALEYGLVNEVVAPDELEARGMELARKLASQSSAAMAAIKRSAHHGFGQDPARAQAYEAAQFGLCFASGDAHEGMAAFKEKRQARFHED

SEQ ID NO: 63 - protein, 261 aa, Artificial
  Substituion in SEQ ID NO 52
MRNLTETFTTYRVEDHVAVLTLNRPQALNALSREVLSDIGAHLAMLDLKDVRVLVIRGEGRVFCAGADIGQMQHMSAVEAESMARLGQRVFQAIEQLPIPVIALIHGGAFGGGLELALACDFRIAAAGAVVGLPEVTLGVNPSFGGTYRLPRAIGFARALSMMLLGERIPVEKALEYGLVNEVVAPDELEARGMDLARKLASQSSAAMAAIKRSAHHGFGQDPARAQAYEAAQFGLCFASGDAHEGMAAFKEKRQARFHED

SEQ ID NO: 64 - DNA, 786 bp, Artificial
  Substituion in SEQ ID NO 53
gtgaggaatttgacagagacgttcaccacgtaccgcgtggaggatcatgtggcggttttgacgctcaatcgtccgcaggctattaacgcgctttctcgagaagtgctgtcggaaatcggtgcgcatcttgcgatgttggatctcaaggacgtccgcgttctcgtcatccgcggcgagggccgggtgttctgcgcgggcgcggacatcggccagatgcagcacatgagcgccgtggaggccgagagcatggcgcgccttgggcagcgcgtgttccaggccatcgaacagctgcccattccggtgattgcgctgattcacggcggggcgtttggcggggggcttgaactcgcgctcgcgtgcgattttcggattgcggccgcaggcgccgtcgtcgggctgcccgaggtgacgctgggggtcaacccgagtttcggcgggacgtaccggctcccgcgcgccatcgggttcgcgcgcgcgctctcgatgatgcttctgggggagcggatcccggtcgagaaggccctggagtacgggctcgtgaacgaggtggtggcgcctgacgagctcgaggcgaggggcatggatctcgcgcgaaaactcgcgagccagtcgagcgccgcgatggcggccatcaagcggtcggcccaccacgggtttgggcaggatccagctcgcgcgcaggcgtatgaggcggcgcagttcggcctgtgctttgcttctggggacgcgcacgagggcatggcggccttcaaggagaagcgccaggcgaggtttcacgaggactga

SEQ ID NO: 65 - DNA, 786 bp, Artificial
  Substituion in SEQ ID NO 53
gtgaggaatttgacagagacgttcaccacgtaccgcgtggaggatcatgtggcggttttgacgctcaatcgtccgcaggctttgaacgcgctttctcgagaagtgctgtcggaaatcggtgcgcatcttgcgatgttggatctcaaggacgtccgcgttctcgtcatccgcggcgagggccgggtgttctgcgcgggcgcggacatcggccagatgcagcacatgagcgccgtggaggccgagagcatggcgcgccttgggcagcgcgtgttccaggccatcgaacagctgcccattccggtgattgcgctgattcacggcggggcgtttggcggggggcttgaactcgcgctcgcgtgcgattttcggattgcggccgcaggcgccgtcgtcgggctgcccgaggtgacgctgggggtcaacccgagtttcggcgggacgtaccggctcccgcgcgccatcgggttcgcgcgcgcgctctcgatgatgcttctgggggagcggatcccggtcgataaggccctggagtacgggctcgtgaacgaggtggtggcgcctgacgagctcgaggcgaggggcatggatctcgcgcgaaaactcgcgagccagtcgagcgccgcgatggcggccatcaagcggtcggcccaccacgggtttgggcaggatccagctcgcgcgcaggcgtatgaggcggcgcagttcggcctgtgctttgcttctggggacgcgcacgagggcatggcggccttcaaggagaagcgccaggcgaggtttcacgaggactga

SEQ ID NO: 66 - DNA, 786 bp, Artificial
  Substituion in SEQ ID NO 53
gtgaggaatttgacagagacgttcaccacgtaccgcattgaggatcatgtggcggttttgacgctcaatcgtccgcaggctttgaacgcgctttctcgagaagtgctgtcggaaatcggtgcgcatcttgcgatgttggatctcaaggacgtccgcgttctcgtcatccgcggcgagggccgggtgttctgcgcgggcgcggacatcggccagatgcagcacatgagcgccgtggaggccgagagcatggcgcgccttgggcagcgcgtgttccaggccatcgaacagctgcccattccggtgattgcgctgattcacggcggggcgtttggcggggggcttgaactcgcgctcgcgtgcgattttcggattgcggccgcaggcgccgtcgtcgggctgcccgaggtgacgctgggggtcaacccgagtttcggcgggacgtaccggctcccgcgcgccatcgggttcgcgcgcgcgctctcgatgatgcttctgggggagcggatcccggtcgagaaggccctggagtacgggctcgtgaacgaggtggtggcgcctgacgagctcgaggcgaggggcatggatctcgcgcgaaaactcgcgagccagtcgagcgccgcgatggcggccatcaagcggtcggcccaccacgggtttgggcaggatccagctcgcgcgcaggcgtatgaggcggcgcagttcggcctgtgctttgcttctggggacgcgcacgagggcatggcggccttcaaggagaagcgccaggcgaggtttcacgaggactga

SEQ ID NO: 67 - DNA, 786 bp, Artificial
  Substituion in SEQ ID NO 53
gtgaggaatttgacagagacgttcaccacgtaccgcgtggaggatcatgtggcggttttgacgctcaatcgtccgcaggctttgaacgcgctttctcgagaagtgctgtcggaaatcggtgcgcatcttgcgatgttggatctcaaggacgtccgcgttctcgtcatccgcggcgagggccgggtgttctgcgcgggcgcggacatcggccagatgcagcacatgagcgccgtggaggccgagagcatggcgcgccttgggcagcgcgtgttccaggccatcgaacagctgcccattccggtgattgcgctgattcacggcggggcgtttggcggggggcttgaactcgcgctcgcgtgcgattttcggattgcggccgcaggcgccgtcgtcgggctgcccgaggtgacgctgggggtcaacccgagtttcggcgggacgtaccggctcccgcgcgccatcgggttcgcgcgcgcgctctcgatgatgcttctgggggagcggatcccggtcgagaaggccctggagtacgggctcgtgaacgaggtggtggcgcctgacgagctcgaggcgaggggcatggaactcgcgcgaaaactcgcgagccagtcgagcgccgcgatggcggccatcaagcggtcggcccaccacgggtttgggcaggatccagctcgcgcgcaggcgtatgaggcggcgcagttcggcctgtgctttgcttctggggacgcgcacgagggcatggcggccttcaaggagaagcgccaggcgaggtttcacgaggactga

SEQ ID NO: 68 - DNA, 786 bp, Artificial
  Substituion in SEQ ID NO 53
gtgaggaatttgacagagacgttcaccacgtaccgcgtggaggatcatgtggcggttttgacgctcaatcgtccgcaggctttgaacgcgctttctcgagaagtgctgtcggatatcggtgcgcatcttgcgatgttggatctcaaggacgtccgcgttctcgtcatccgcggcgagggccgggtgttctgcgcgggcgcggacatcggccagatgcagcacatgagcgccgtggaggccgagagcatggcgcgccttgggcagcgcgtgttccaggccatcgaacagctgcccattccggtgattgcgctgattcacggcggggcgtttggcggggggcttgaactcgcgctcgcgtgcgattttcggattgcggccgcaggcgccgtcgtcgggctgcccgaggtgacgctgggggtcaacccgagtttcggcgggacgtaccggctcccgcgcgccatcgggttcgcgcgcgcgctctcgatgatgcttctgggggagcggatcccggtcgagaaggccctggagtacgggctcgtgaacgaggtggtggcgcctgacgagctcgaggcgaggggcatggatctcgcgcgaaaactcgcgagccagtcgagcgccgcgatggcggccatcaagcggtcggcccaccacgggtttgggcaggatccagctcgcgcgcaggcgtatgaggcggcgcagttcggcctgtgctttgcttctggggacgcgcacgagggcatggcggccttcaaggagaagcgccaggcgaggtttcacgaggactga

SEQ ID NO: 69 - protein, 376 aa, Alicyclobacillus acidocaldarius
MMEWDVYEARRALHQIPEPGFREFETQKLVLSYLQALPQEHLEIRTWETGVIALVKGHSPKRRVGWRADMDGLPVAEETGVPYASRHPGMMHACGHDVHMAVALGLAQHFAHNPPPDDLVLVFQPAEEGPGGAQPMLASEAFQAVRPEMIFALHVQPDMAVGEIGIRPGVLFANTSELFIHLVGQGGHAAYPHRANDMVVAGAHLVTALQTIVARNVDPLDSAVITVGRLESGTKMNIIAERARLEGTVRALNAATMPRLKNRIEAVVAGIERMFNCQAEIDYGANYYQVYNDERLTRGFMQFVEEAGLADVHEVPPAMTGEDFGYFLREIPGFLFWLGAATPYGLHHAKMLPDERCIDVALRVLIPYFAERRYEA

SEQ ID NO: 70 - DNA, 1131 bp, Alicyclobacillus acidocaldarius
gtgatggagtgggatgtgtacgaagcgcggcgcgccctgcaccaaattccagagcccggatttcgggagtttgagacgcagaaactggtgctctcgtatctgcaggcgctcccacaggagcacctggagatccgcacgtgggagacgggcgtgattgcgctcgtgaagggacacagtccgaagcgacgcgtgggctggcgcgcggacatggacgggctgcccgtggcggaggagacgggcgtcccgtatgcgtcgcgccatccgggcatgatgcacgcctgcgggcacgacgtgcacatggccgtcgcgctcggcctcgctcagcacttcgcccacaaccctccgccggacgatctcgtcctcgtctttcagcccgccgaggagggcccgggcggcgcacagccgatgctcgcgagcgaggcgtttcaggccgtgcggcctgagatgatcttcgcactgcacgtgcagcccgacatggctgtaggcgagattggcatccggcccggcgtgctgtttgcgaacacgtccgagctgttcatccatctcgtcggccaaggagggcacgcggcctatccgcaccgggccaacgacatggtggtggcgggtgcacacctcgtgacggcgctgcagaccatcgtggcgcgaaatgtggatccgttagacagcgcggtcatcaccgtggggcggctggagtcgggcacgaagatgaatatcatcgcggagcgcgcgcgcctcgagggcactgtccgggcactcaacgcggccaccatgccccgcctcaagaaccgaattgaggcggtggtggcagggattgagcggatgttcaactgccaggccgagatcgactacggcgcgaattactaccaggtgtacaacgacgagcgcctcacccgcgggttcatgcagtttgtcgaggaggccgggctcgccgacgtgcacgaggttccgcccgccatgacgggcgaggatttcggctactttctgcgcgaaatcccgggttttctgttctggctcggcgcggccacgccgtacggcctgcaccacgccaagatgctcccggacgagcgatgcatcgacgtggcgctgcgcgtgctcatcccgtacttcgccgagcggcgatacgaggcttga

SEQ ID NO: 71 - protein, 361 aa, Geobacillus kaustophilus HTA426
RRDLHQIPELGFQEFKTQQYLLRYIQSLPQERLQVRTWKTGIFVKVNGTSPRKTIGYRADMDGLPIREETGLPYRSKHEGRMHACGHDVHMSIALGVLTHFAHHPLKDDLLFVFQPAEEGPGGAKPMLESDIMREWKPDIIVALHIAPEYPVGTIATKEGLLFANTSELFIDLKGKGGHAAFPHLANDMVVAACALVTQLQSIVARNVDPLDSAVITIGKIAGGTVQNVIAEHARLEGTIRTLSTAAMQKVKRRIEAIVHGIEVAYECEASIDYGAMYHEVYNDPDLTAEFMKFAKAHGGVNVIRCKEAMTGEDFGYMLADIPGFMFWLGVASPYGLHHAKLAPNEEAIDRAIAFLIDYFS

SEQ ID NO: 72 - protein, 361 aa, Geobacillus thermodenitrificans NG80-2
RRDLHKIPELGFQEFKTQQYLLNYIQSLPQERLDVRTWKTGIFVKVSGTAPRKTIGYRADIDGLPISEETGLPYRSEHAGQMHACGHDVHMSIALGVLTHFAHNPIRDDLLFIFQPAEEGPGGAKPMLESDIMREWKPDMIVALHIAPEYPVGTIATKEGLLFANTSELFIDLKGKGGHAAFPHLANDMVVAACALVTQLQSIVARNVDPLDSAVITIGKITSGTVQNVIAEHARLEGTIRTLSIDAMQAVKRRIEALVRGVEVAYECEAVIDYGAMYHEVYNNPALTTEFIQFAETHTDMNVIRCKEAMTGEDFGYMLAEIPGFMFWLGVDSPYGLHHAKLVPNEAAIDRAIAFLISYFS

SEQ ID NO: 73 - protein, 361 aa, Bacillus weihenstephanensis KBAB4
QVRRDLHKIPEIGFKEWKTQQYILDYIGTLPNEYLEVKTWKTGVIVKVNGKNPEKIIGYRADIDGLPITEETGYEYSSVHEGMMHACGHDLHATIGLGLLTAAVSERIDDDLVFIFQPAEEGPGGALPMLESDELKEWKPNMILGLHIAPEYSVGTIATKEGLLFANTSELYVDLKGKGGHAAYPHTANDMIVAASHLVTQLQSVISRNVNPLDSAVITIGKITGGTVQNIIAEKSRLEGTIRTLSVESMKRVKSRIEAIVAGIEASFQCEAVIDYGAMYHQVYNHEELTREFMQFTREQTTMDVITCTEAMTGEDFGYMLREIPGFMFWLGVNSEYGLHHAKLKPDEEVIEKAIVFLNQY

SEQ ID NO: 74 - protein, 361 aa, Bacillus cereus subsp. cytotoxis NVH 391-98
QIRRDLHQIPELGFQEWKTQQYILNYIETLPNEHIEVKTWKTGVIVKVKGKNPVKTIGYRADMDGLPIVEETGYEFASTHEGMMHACGHDFHTTIGLGLLTATVNDRIDDDLVFLFQPAEEGPGGALPMLESEELKEWKPNMILGLHIAPEYPVGTIATKEGLLFANTSELYIDLKGKGGHAAYPHMANDMIVAASHLVTQLQSVISRNVNPLDSAVITIGKITGGTVQNIIAEKSRLEGTIRTLSVESMKRVKDRIEAIVAGIEAAFQCEAVIDYGAMYHQVYNHEALTKEFMEFASKDTNMNVVTCKEAMTGEDFGYMLRDIPGFMFWLGVDSEYGLHHAKLKPNEAAIDRAIEFLNQY

SEQ ID NO: 75 - protein, 367 aa, Bacillus coagulans 36D1
METNLIAIRRDLHRIPELGYKEHKTQRYILDFISRLPKGHLEVKTWKTGVLVKVKGTCPEKKIGYRTDIDGLPIKEETGFPFQSEHEGNMHACGHDFHMTIALGILSHFASRPVKDDLIFIFQPAEEGPGGAKAMLEEVLHDEWQPDLVMALHVAPEYPAGTVAVKKGLLFANTSELYIDLEGKGGHAAYPQHTKDMVVAAAHLVTQLQSIISRNIDPLDSAVVTIGKITGGTVQNAIAEHARLEGTIRTLSSEAMEKVKHRIEALTNGLSAGFECRAEIDYGCNYYQVFNHPEETARFMDFVRSYEGAHLHECREALTGEDFGYMLKEIPGFMFWLGVGSPYGLHHAKFAPDERALETAADLMIAY

SEQ ID NO: 76 - protein, 376 aa, Artificial
  Substituion in SEQ ID NO 69
MMEWDVYEARRALHQIPEPGFREFETQKLVLSYLQALPQEHLEIRTWETGVIALVKGHSPKRRVGWRADMDGLPVAEETGVPYASRHPGMMHACGHDVHMAVALGLAQHFAHNPPPDDLVLVFQPAEEGPGGAQPMLASEAFQAVRPEMIFALHVQPDMAVGEIGIRPGVLFANTSELFIHLVGQGGHAAYPHRANDMVVAGAHLVTALQTIVARNVDPLDSAVITVGRLESGTKMNIIAERARLEGTVRALNAATMPRLKNRIEAVVAGIERMFNCQAEIDYGANYYQVYNDERLTRGFMQFVEEAGLADVHEVPPAMTGEDFGYFLREIPGFLFWLGAATPYGLHHAKMLPDERCIDIALRVLIPYFAERRYEA

SEQ ID NO: 77 - protein, 376 aa, Artificial
  Substituion in SEQ ID NO 69
MMEWDVYEARRALHQIPEPGFREFETQKLVLSYLQALPQEHLEIRTWETGVIALVKGHSPKRRVGWRADMDGLPVAEETGVPYASRHPGMMHACGHDVHMAVALGLAQHFAHNPPPDDLVLVFQPAEEGPGGAQPMLASEAFQAVRPEMIFALHVQPDMAVGEIGIRPGVLFANTSELFIHLVGQGGHAAYPHRANDMVVAGAHLVTALQTIVARNVDPLDSAVITVGRLESGTKMNIIAERARLEGTVRALNAATMPRLKNRIEAVVAGIERMFNCQAEIDYGANYYQVYNDEKLTRGFMQFVEEAGLADVHEVPPAMTGEDFGYFLREIPGFLFWLGAATPYGLHHAKMLPDERCIDVALRVLIPYFAERRYEA

SEQ ID NO: 78 - protein, 376 aa, Artificial
  Substituion in SEQ ID NO 69
MMEWDVYEARRALHQIPEPGFREFETQKLVLSYLQALPQEHLEIRTWETGVIALVKGHSPKRRVGWRADMDGLPVAEETGVPYASRHPGMMHACGHDVHMAVALGLAQHFAHNPPPDDLVLVFQPAEEGPGGAQPMLASEAFQAVRPEMIFALHVQPDMAVGEIGIRPGVLFANTSELFIHLVGQGGHAAYPHRANDMVVAGAHLVTALQTIVARNVDPLDSAVITVGRLESGTKMNIIAERARLEGTVRALNAATMPRLKNRIEAVVAGIERMFNCQAEIDYGANYYQVYNDERLTRGFMQFVEEAGLADVHEVPPAMTGEDFGYFLREIPGFLFWLGAATPYGLHHAKMIPDERCIDVALRVLIPYFAERRYEA

SEQ ID NO: 79 - protein, 376 aa, Artificial
  Substituion in SEQ ID NO 69
MMEWDVYEARRALHQIPEPGFREFETQKLVLSYLQALPQEHLEIRTWETGVIALVKGHSPKRRVGWRADMDGLPVAEETGVPYASRHPGMMHACGHDVHMAVALGLAQHFAHNPPPDDLVLVFQPAEEGPGGAQPMLASEAFQAVRPEMIFALHVQPDMAVGEIGIRPGVLFANTSELFIHLVGQGGHAAYPHRANDMVVAGAHLVTALQTIVARNVDPLDSAVITVGRLESGTKMNIIAERARLEGTVRALNAATMPRLKNRIEAVVAGIERMFNCQAEIDYGANYYQVYNDERLTRGFMQFVEEAGLADVHEVPPAMTGEDFGYFLREIPGFLFWLGAATPYGLHHAKMLPDERCIDVALRVLIPYFAERKYEA

SEQ ID NO: 80 - protein, 376 aa, Artificial
  Substituion in SEQ ID NO 69
MMEWDVYEARRALHQIPEPGFREFETQKLVLSYLQALPQEHLEIRTWETGVIALVKGHSPKRRVGWRADMDGLPVAEETGVPYASRHPGMMHACGHDVHMAVALGLAQHFAHNPPPDDLVLVFQPAEEGPGGAQPMLASEAFQAVRPEMIFALHVQPDMAVGEIGIRPGVLFANTSELFIHLVGQGGHAAYPHRANDMVVAGAHLVTALQTIVARNVDPLDSAVITVGRLESGTKMNIIAERARLEGTVRALNAATMPRLKNRIEAVVAGIERMFNCQAEIDYGANYYQVYNDERLTRGFMQFVDEAGLADVHEVPPAMTGEDFGYFLREIPGFLFWLGAATPYGLHHAKMLPDERCIDVALRVLIPYFAERRYEA

SEQ ID NO: 81 - DNA, 1131 bp, Artificial
  Substituion in SEQ ID NO 70
gtgatggagtgggatgtgtacgaagcgcggcgcgccctgcaccaaattccagagcccggatttcgggagtttgagacgcagaaactggtgctctcgtatctgcaggcgctcccacaggagcacctggagatccgcacgtgggagacgggcgtgattgcgctcgtgaagggacacagtccgaagcgacgcgtgggctggcgcgcggacatggacgggctgcccgtggcggaggagacgggcgtcccgtatgcgtcgcgccatccgggcatgatgcacgcctgcgggcacgacgtgcacatggccgtcgcgctcggcctcgctcagcacttcgcccacaaccctccgccggacgatctcgtcctcgtctttcagcccgccgaggagggcccgggcggcgcacagccgatgctcgcgagcgaggcgtttcaggccgtgcggcctgagatgatcttcgcactgcacgtgcagcccgacatggctgtaggcgagattggcatccggcccggcgtgctgtttgcgaacacgtccgagctgttcatccatctcgtcggccaaggagggcacgcggcctatccgcaccgggccaacgacatggtggtggcgggtgcacacctcgtgacggcgctgcagaccatcgtggcgcgaaatgtggatccgttagacagcgcggtcatcaccgtggggcggctggagtcgggcacgaagatgaatatcatcgcggagcgcgcgcgcctcgagggcactgtccgggcactcaacgcggccaccatgccccgcctcaagaaccgaattgaggcggtggtggcagggattgagcggatgttcaactgccaggccgagatcgactacggcgcgaattactaccaggtgtacaacgacgagcgcctcacccgcgggttcatgcagtttgtcgaggaggccgggctcgccgacgtgcacgaggttccgcccgccatgacgggcgaggatttcggctactttctgcgcgaaatcccgggttttctgttctggctcggcgcggccacgccgtacggcctgcaccacgccaagatgctcccggacgagcgatgcatcgacattgcgctgcgcgtgctcatcccgtacttcgccgagcggcgatacgaggcttga

SEQ ID NO: 82 - DNA, 1131 bp, Artificial
  Substituion in SEQ ID NO 70
gtgatggagtgggatgtgtacgaagcgcggcgcgccctgcaccaaattccagagcccggatttcgggagtttgagacgcagaaactggtgctctcgtatctgcaggcgctcccacaggagcacctggagatccgcacgtgggagacgggcgtgattgcgctcgtgaagggacacagtccgaagcgacgcgtgggctggcgcgcggacatggacgggctgcccgtggcggaggagacgggcgtcccgtatgcgtcgcgccatccgggcatgatgcacgcctgcgggcacgacgtgcacatggccgtcgcgctcggcctcgctcagcacttcgcccacaaccctccgccggacgatctcgtcctcgtctttcagcccgccgaggagggcccgggcggcgcacagccgatgctcgcgagcgaggcgtttcaggccgtgcggcctgagatgatcttcgcactgcacgtgcagcccgacatggctgtaggcgagattggcatccggcccggcgtgctgtttgcgaacacgtccgagctgttcatccatctcgtcggccaaggagggcacgcggcctatccgcaccgggccaacgacatggtggtggcgggtgcacacctcgtgacggcgctgcagaccatcgtggcgcgaaatgtggatccgttagacagcgcggtcatcaccgtggggcggctggagtcgggcacgaagatgaatatcatcgcggagcgcgcgcgcctcgagggcactgtccgggcactcaacgcggccaccatgccccgcctcaagaaccgaattgaggcggtggtggcagggattgagcggatgttcaactgccaggccgagatcgactacggcgcgaattactaccaggtgtacaacgacgagaaactcacccgcgggttcatgcagtttgtcgaggaggccgggctcgccgacgtgcacgaggttccgcccgccatgacgggcgaggatttcggctactttctgcgcgaaatcccgggttttctgttctggctcggcgcggccacgccgtacggcctgcaccacgccaagatgctcccggacgagcgatgcatcgacgtggcgctgcgcgtgctcatcccgtacttcgccgagcggcgatacgaggcttga

SEQ ID NO: 83 - DNA, 1131 bp, Artificial
  Substituion in SEQ ID NO 70
gtgatggagtgggatgtgtacgaagcgcggcgcgccctgcaccaaattccagagcccggatttcgggagtttgagacgcagaaactggtgctctcgtatctgcaggcgctcccacaggagcacctggagatccgcacgtgggagacgggcgtgattgcgctcgtgaagggacacagtccgaagcgacgcgtgggctggcgcgcggacatggacgggctgcccgtggcggaggagacgggcgtcccgtatgcgtcgcgccatccgggcatgatgcacgcctgcgggcacgacgtgcacatggccgtcgcgctcggcctcgctcagcacttcgcccacaaccctccgccggacgatctcgtcctcgtctttcagcccgccgaggagggcccgggcggcgcacagccgatgctcgcgagcgaggcgtttcaggccgtgcggcctgagatgatcttcgcactgcacgtgcagcccgacatggctgtaggcgagattggcatccggcccggcgtgctgtttgcgaacacgtccgagctgttcatccatctcgtcggccaaggagggcacgcggcctatccgcaccgggccaacgacatggtggtggcgggtgcacacctcgtgacggcgctgcagaccatcgtggcgcgaaatgtggatccgttagacagcgcggtcatcaccgtggggcggctggagtcgggcacgaagatgaatatcatcgcggagcgcgcgcgcctcgagggcactgtccgggcactcaacgcggccaccatgccccgcctcaagaaccgaattgaggcggtggtggcagggattgagcggatgttcaactgccaggccgagatcgactacggcgcgaattactaccaggtgtacaacgacgagcgcctcacccgcgggttcatgcagtttgtcgaggaggccgggctcgccgacgtgcacgaggttccgcccgccatgacgggcgaggatttcggctactttctgcgcgaaatcccgggttttctgttctggctcggcgcggccacgccgtacggcctgcaccacgccaagatgattccggacgagcgatgcatcgacgtggcgctgcgcgtgctcatcccgtacttcgccgagcggcgatacgaggcttga

SEQ ID NO: 84 - DNA, 1131 bp, Artificial
  Substituion in SEQ ID NO 70
gtgatggagtgggatgtgtacgaagcgcggcgcgccctgcaccaaattccagagcccggatttcgggagtttgagacgcagaaactggtgctctcgtatctgcaggcgctcccacaggagcacctggagatccgcacgtgggagacgggcgtgattgcgctcgtgaagggacacagtccgaagcgacgcgtgggctggcgcgcggacatggacgggctgcccgtggcggaggagacgggcgtcccgtatgcgtcgcgccatccgggcatgatgcacgcctgcgggcacgacgtgcacatggccgtcgcgctcggcctcgctcagcacttcgcccacaaccctccgccggacgatctcgtcctcgtctttcagcccgccgaggagggcccgggcggcgcacagccgatgctcgcgagcgaggcgtttcaggccgtgcggcctgagatgatcttcgcactgcacgtgcagcccgacatggctgtaggcgagattggcatccggcccggcgtgctgtttgcgaacacgtccgagctgttcatccatctcgtcggccaaggagggcacgcggcctatccgcaccgggccaacgacatggtggtggcgggtgcacacctcgtgacggcgctgcagaccatcgtggcgcgaaatgtggatccgttagacagcgcggtcatcaccgtggggcggctggagtcgggcacgaagatgaatatcatcgcggagcgcgcgcgcctcgagggcactgtccgggcactcaacgcggccaccatgccccgcctcaagaaccgaattgaggcggtggtggcagggattgagcggatgttcaactgccaggccgagatcgactacggcgcgaattactaccaggtgtacaacgacgagcgcctcacccgcgggttcatgcagtttgtcgaggaggccgggctcgccgacgtgcacgaggttccgcccgccatgacgggcgaggatttcggctactttctgcgcgaaatcccgggttttctgttctggctcggcgcggccacgccgtacggcctgcaccacgccaagatgctcccggacgagcgatgcatcgacgtggcgctgcgcgtgctcatcccgtacttcgccgagcggaaatacgaggcttga

SEQ ID NO: 85 - DNA, 1131 bp, Artificial
  Substituion in SEQ ID NO 70
gtgatggagtgggatgtgtacgaagcgcggcgcgccctgcaccaaattccagagcccggatttcgggagtttgagacgcagaaactggtgctctcgtatctgcaggcgctcccacaggagcacctggagatccgcacgtgggagacgggcgtgattgcgctcgtgaagggacacagtccgaagcgacgcgtgggctggcgcgcggacatggacgggctgcccgtggcggaggagacgggcgtcccgtatgcgtcgcgccatccgggcatgatgcacgcctgcgggcacgacgtgcacatggccgtcgcgctcggcctcgctcagcacttcgcccacaaccctccgccggacgatctcgtcctcgtctttcagcccgccgaggagggcccgggcggcgcacagccgatgctcgcgagcgaggcgtttcaggccgtgcggcctgagatgatcttcgcactgcacgtgcagcccgacatggctgtaggcgagattggcatccggcccggcgtgctgtttgcgaacacgtccgagctgttcatccatctcgtcggccaaggagggcacgcggcctatccgcaccgggccaacgacatggtggtggcgggtgcacacctcgtgacggcgctgcagaccatcgtggcgcgaaatgtggatccgttagacagcgcggtcatcaccgtggggcggctggagtcgggcacgaagatgaatatcatcgcggagcgcgcgcgcctcgagggcactgtccgggcactcaacgcggccaccatgccccgcctcaagaaccgaattgaggcggtggtggcagggattgagcggatgttcaactgccaggccgagatcgactacggcgcgaattactaccaggtgtacaacgacgagcgcctcacccgcgggttcatgcagtttgtcgatgaggccgggctcgccgacgtgcacgaggttccgcccgccatgacgggcgaggatttcggctactttctgcgcgaaatcccgggttttctgttctggctcggcgcggccacgccgtacggcctgcaccacgccaagatgctcccggacgagcgatgcatcgacgtggcgctgcgcgtgctcatcccgtacttcgccgagcggcgatacgaggcttga

SEQ ID NO: 86 - protein, 339 aa, Alicyclobacillus acidocaldarius
MHEGALTMMKIDYQTNWIDLARRVLDGRGVTREEALDILRSSDDELLDLLAAAFLIRRRYFGKKVKLNMIINAKSKMCPEDCAYCSQSAISKAPVSKYPLVSKEEIIAGAREAERRKAGTYCIVISGRRPSDREIERIAEAVEEIRATTTLKICCCLGLLTPAQADRLARAGVHRYNHNLNTSRDRYGDICTTHTYDDRVRTLEHVKEAGISPCSGVIFGMGESDEEAVDMAFALKEMDADSIPCNFLNPIPGTPLEGMETLNPRRCLKLLCMMRFVNPSKEIRIAGGRERNLRSLQVLGLYPANSIFVGDYLTTPGQAPTEDWAMIEDLGFEIEECAL

SEQ ID NO: 87 - DNA, 1020 bp, Alicyclobacillus acidocaldarius
gtgcacgagggggcattgaccatgatgaaaatcgattatcagaccaattggattgacctcgcccgtcgcgtccttgatgggcgcggcgtgactcgcgaggaagccctcgacattctgcggtcgagcgacgacgaactcctagatctcctcgccgccgccttcttgattcgcaggcgctacttcggtaagaaggtcaagctcaacatgatcatcaacgccaagtcgaagatgtgccccgaagactgcgcgtactgctcccagtccgccatctcaaaggccccggtgtccaagtatccgctggtctccaaagaggaaatcatcgccggcgcgcgcgaagccgagcgtcgcaaggccggcacgtattgcatcgtcatcagcggaaggcggccgtcggatcgggagattgagcgcatcgccgaggccgtggaggaaatccgcgccaccacaaccctcaagatctgctgctgcctcgggctcttgacgcccgcccaggcggatcggctcgcccgggccggcgtgcaccggtacaatcacaacttgaacacgagccgagatcgatatggcgacatttgcaccacccacacctacgacgatcgcgtccggaccctggagcacgtgaaagaggcgggcatctcgccgtgttcgggggtcatcttcggcatgggcgaatcggacgaggaggcggtggacatggcgtttgcgctgaaggagatggacgccgactccatcccgtgcaactttctgaatcccatcccaggcacgccgctcgaaggcatggagaccttgaacccgcggcggtgcctgaagctgctctgcatgatgcgcttcgtgaatccgtcgaaggagatccgcatcgcaggcgggcgagagcgaaacctgcgcagcctgcaggtgctcggcctctacccggccaactccatcttcgtcggggactacttgacgacgcccgggcaggcgccgacggaggactgggccatgatcgaagacctcgggtttgagattgaagaatgcgcgctgtga

SEQ ID NO: 88 - protein, 332 aa, Bacillus cereus subsp. cytotoxis NVH 391-98
MKQIQTKVDWKKIAFEGIEGKRITKEDALAILEADDTEVLEIMNAAYMIRHHYFGKKVKLNMIINTKSGLCPEDCGYCSQSIVSEAPIDKYAWLTQEKIVEGAHEAVRRKAGTYCIVASGRRPTDKEVNHVIGAVKEIKETTDLKICCCLGFLNEDQAKRLAEAGVHRYNHNLNTHANHYDNICSTHTYDDRVDTVEKVKQAGISPCSGAIFGMGETKEERVEIAFELQRLDADSIPCNFLVSVKGTPFEGRKELTPVECLKILAMMRFVNPSKEIRISGGRELNLRSVQPLGLFAANSIFVGDYLTTVGQESTADWEMIQDLGFEIEECAL

SEQ ID NO: 89 - protein, 332 aa, Kurthia sp. 538-KA26
GLETLVKKDWKMLAENVIKGYKVTAEEALAIVQAPDNEVLEILNAAFLIRQHYYGKKVKLNMIINTKSGLCPEDCGYCSQSIVSEAPIDKYAWLTKEKIVEGAQESIRRKAGTYCIVASGRRPTNREIDHVIEAVKEIRETTDLKICCCLGFLNETHASKLAEAGVHRYKHNLNTSQDNYKNITSTHTYEDRVDTVEAVKEAGMSPCSGAIFGMNESNEEAVEIALSLRSLDADSIPCNFLNAIDGTPLEGTSELTPTKCLKLISMMRFVNPSKEIRLAGGREVNLRSMQPMALYAANSIFVGDYLTTAGQEPTADWGIIEDLGFEIEECAL

SEQ ID NO: 90 - protein, 332 aa, Bacillus anthracis str. Ames
MKQVQTKRDWKKLAYDVVEEKMITKEDAIAILEADDTEVLEIMNAAYIIRHHYFGKKVKLNMIINTKSGLCPEDCGYCSQSIISEAPIDKYAWLTQEKIVEGAHEAIRRKAGTYCIVASGRRPTDKEVNHVIGAVKEIRETTDLKICCCLGFLNEDQAGRLAEAGVHRYNHNLNTHANNYESICSTHTYDDRVDTVQKAKQAGISPCSGAIFGMGETIEERAEIAFELQRIDADSIPCNFLVAVKGTPLEGQKELTPVECLKVLAMMRFVNPTKEIRISGGREINLRSVQPIGLFAANSIFVGDYLTTAGQEPTADWGMIEDLGFEIEECAL

SEQ ID NO: 91 - protein, 332 aa, Bacillus thuringiensis str. Al Hakam
MKQVQTKRDWKKLAYDVVEEKMIAKEDAIAILEAEDTEVLEIMNAAYIIRHHYFGKKVKLNMIINTKSGLCPEDCGYCSQSIISEAPIDKYAWLTQEKIVEGAHEAIRRKAGTYCIVASGRRPTDKEVNHVIGAVKEIRETTDLKICCCLGFLNEDQAGRLAEAGVHRYNHNLNTHANNYENICSTHTYDDRVDTVQKAKQAGISPCSGAIFGMGETIEERAEIAFELQRIDADSIPCNFLVAVKGTPLEGQKELTPVECLKVLAMMRFVNPTKEIRISGGREINLRSVQPIGLFAANSIFVGDYLTTAGQEPTADWGMIEDLGFEIEECAL

SEQ ID NO: 92 - protein, 332 aa, Bacillus cereus G9241
MKQVQTKRDWKKLAYDVVEEKMITKEDAIAILEADETEVLEIMNAAYIIRHHHFGKKVKLNMIINTKSGLCPEDCGYCSQSIISEAPIDKYAWLTQEKIVEGAHEAIRRKAGTYCIVASGRRPTDKEVNHVIGAVKEIRETTDLKICCCLGFLNEDQAGRLAEAGVHRYNHNLNTHANNYESICSTHTYDDRVDTVQKAKQAGISPCSGAIFGMGETIEERAEIAFELQRIDADSIPCNFLVAVKGTPLEGQKELTPVECLKVLAMMRFVNPTKEIRISGGREINLRSVQPIGLFAANSIFVGDYLTTAGQEPTADWGMIEDLGFEIEECAL

SEQ ID NO: 93 - protein, 339 aa, Artificial
  Substituion in SEQ ID NO 86
MHEGALTMMKIDYQTNWIDLAKRVLDGRGVTREEALDILRSSDDELLDLLAAAFLIRRRYFGKKVKLNMIINAKSKMCPEDCAYCSQSAISKAPVSKYPLVSKEEIIAGAREAERRKAGTYCIVISGRRPSDREIERIAEAVEEIRATTTLKICCCLGLLTPAQADRLARAGVHRYNHNLNTSRDRYGDICTTHTYDDRVRTLEHVKEAGISPCSGVIFGMGESDEEAVDMAFALKEMDADSIPCNFLNPIPGTPLEGMETLNPRRCLKLLCMMRFVNPSKEIRIAGGRERNLRSLQVLGLYPANSIFVGDYLTTPGQAPTEDWAMIEDLGFEIEECAL

SEQ ID NO: 94 - protein, 339 aa, Artificial
  Substituion in SEQ ID NO 86
MHEGALTMMKIDYQTNWIDLARRVLDGRGVTREEALDILRSSDDELLDLLAAAFLIRRRYFGKKVKLNMIINAKSKMCPEDCAYCSQSAISKAPVSKYPLVSKEEIIAGAREAERRKAGTYCIVISGRRPSDREIERIAEAVEEIRATTTLKICCCLGLLTPAQADRLARAGVHRYNHNLNTSKDRYGDICTTHTYDDRVRTLEHVKEAGISPCSGVIFGMGESDEEAVDMAFALKEMDADSIPCNFLNPIPGTPLEGMETLNPRRCLKLLCMMRFVNPSKEIRIAGGRERNLRSLQVLGLYPANSIFVGDYLTTPGQAPTEDWAMIEDLGFEIEECAL

SEQ ID NO: 95 - protein, 339 aa, Artificial
  Substituion in SEQ ID NO 86
MHEGALTMMKIDYQTNWIDLARRVLDGRGVTREEALDILRSSDDELLDLLAAAFLIRRRYFGKKVKLNMIINAKSKMCPEDCAYCSQSAISKAPVSKYPLVSKEEIIAGAREADRRKAGTYCIVISGRRPSDREIERIAEAVEEIRATTTLKICCCLGLLTPAQADRLARAGVHRYNHNLNTSRDRYGDICTTHTYDDRVRTLEHVKEAGISPCSGVIFGMGESDEEAVDMAFALKEMDADSIPCNFLNPIPGTPLEGMETLNPRRCLKLLCMMRFVNPSKEIRIAGGRERNLRSLQVLGLYPANSIFVGDYLTTPGQAPTEDWAMIEDLGFEIEECAL

SEQ ID NO: 96 - protein, 339 aa, Artificial
  Substituion in SEQ ID NO 86
MHEGALTMMKIDYQTNWIDLARRVLDGKGVTREEALDILRSSDDELLDLLAAAFLIRRRYFGKKVKLNMIINAKSKMCPEDCAYCSQSAISKAPVSKYPLVSKEEIIAGAREAERRKAGTYCIVISGRRPSDREIERIAEAVEEIRATTTLKICCCLGLLTPAQADRLARAGVHRYNHNLNTSRDRYGDICTTHTYDDRVRTLEHVKEAGISPCSGVIFGMGESDEEAVDMAFALKEMDADSIPCNFLNPIPGTPLEGMETLNPRRCLKLLCMMRFVNPSKEIRIAGGRERNLRSLQVLGLYPANSIFVGDYLTTPGQAPTEDWAMIEDLGFEIEECAL

SEQ ID NO: 97 - protein, 339 aa, Artificial
  Substituion in SEQ ID NO 86
MHEGALTMMKIDYQTNWIDLARRVLDGRGVTREEALDILRSSDDELLDLLAAAFLIRRRYFGKKVKLNMIINAKSKMCPEDCAYCSQSAISKAPVSKYPLVSKEEIIAGAREAERRKAGTYCIVISGRRPSDREIERIAEAVEEIRATTTLKICCCLGLLTPAQADRLARAGVHRYNHNLNTSRDRYGDICTTHTYDDRVRTLEHVKEAGISPCSGVIFGMGESDEEAVDMAFALKEMDADSIPCNFLNPIPGTPLEGMETLNPRRCLKLLCMMRFVNPSKEIRIAGGREKNLRSLQVLGLYPANSIFVGDYLTTPGQAPTEDWAMIEDLGFEIEECAL

SEQ ID NO: 98 - DNA, 1020 bp, Artificial
  Substituion in SEQ ID NO 87
gtgcacgagggggcattgaccatgatgaaaatcgattatcagaccaattggattgacctcgccaaacgcgtccttgatgggcgcggcgtgactcgcgaggaagccctcgacattctgcggtcgagcgacgacgaactcctagatctcctcgccgccgccttcttgattcgcaggcgctacttcggtaagaaggtcaagctcaacatgatcatcaacgccaagtcgaagatgtgccccgaagactgcgcgtactgctcccagtccgccatctcaaaggccccggtgtccaagtatccgctggtctccaaagaggaaatcatcgccggcgcgcgcgaagccgagcgtcgcaaggccggcacgtattgcatcgtcatcagcggaaggcggccgtcggatcgggagattgagcgcatcgccgaggccgtggaggaaatccgcgccaccacaaccctcaagatctgctgctgcctcgggctcttgacgcccgcccaggcggatcggctcgcccgggccggcgtgcaccggtacaatcacaacttgaacacgagccgagatcgatatggcgacatttgcaccacccacacctacgacgatcgcgtccggaccctggagcacgtgaaagaggcgggcatctcgccgtgttcgggggtcatcttcggcatgggcgaatcggacgaggaggcggtggacatggcgtttgcgctgaaggagatggacgccgactccatcccgtgcaactttctgaatcccatcccaggcacgccgctcgaaggcatggagaccttgaacccgcggcggtgcctgaagctgctctgcatgatgcgcttcgtgaatccgtcgaaggagatccgcatcgcaggcgggcgagagcgaaacctgcgcagcctgcaggtgctcggcctctacccggccaactccatcttcgtcggggactacttgacgacgcccgggcaggcgccgacggaggactgggccatgatcgaagacctcgggtttgagattgaagaatgcgcgctgtga

SEQ ID NO: 99 - DNA, 1020 bp, Artificial
  Substituion in SEQ ID NO 87
gtgcacgagggggcattgaccatgatgaaaatcgattatcagaccaattggattgacctcgcccgtcgcgtccttgatgggcgcggcgtgactcgcgaggaagccctcgacattctgcggtcgagcgacgacgaactcctagatctcctcgccgccgccttcttgattcgcaggcgctacttcggtaagaaggtcaagctcaacatgatcatcaacgccaagtcgaagatgtgccccgaagactgcgcgtactgctcccagtccgccatctcaaaggccccggtgtccaagtatccgctggtctccaaagaggaaatcatcgccggcgcgcgcgaagccgagcgtcgcaaggccggcacgtattgcatcgtcatcagcggaaggcggccgtcggatcgggagattgagcgcatcgccgaggccgtggaggaaatccgcgccaccacaaccctcaagatctgctgctgcctcgggctcttgacgcccgcccaggcggatcggctcgcccgggccggcgtgcaccggtacaatcacaacttgaacacgagcaaagatcgatatggcgacatttgcaccacccacacctacgacgatcgcgtccggaccctggagcacgtgaaagaggcgggcatctcgccgtgttcgggggtcatcttcggcatgggcgaatcggacgaggaggcggtggacatggcgtttgcgctgaaggagatggacgccgactccatcccgtgcaactttctgaatcccatcccaggcacgccgctcgaaggcatggagaccttgaacccgcggcggtgcctgaagctgctctgcatgatgcgcttcgtgaatccgtcgaaggagatccgcatcgcaggcgggcgagagcgaaacctgcgcagcctgcaggtgctcggcctctacccggccaactccatcttcgtcggggactacttgacgacgcccgggcaggcgccgacggaggactgggccatgatcgaagacctcgggtttgagattgaagaatgcgcgctgtga

SEQ ID NO: 100 - DNA, 1020 bp, Artificial
  Substituion in SEQ ID NO 87
gtgcacgagggggcattgaccatgatgaaaatcgattatcagaccaattggattgacctcgcccgtcgcgtccttgatgggcgcggcgtgactcgcgaggaagccctcgacattctgcggtcgagcgacgacgaactcctagatctcctcgccgccgccttcttgattcgcaggcgctacttcggtaagaaggtcaagctcaacatgatcatcaacgccaagtcgaagatgtgccccgaagactgcgcgtactgctcccagtccgccatctcaaaggccccggtgtccaagtatccgctggtctccaaagaggaaatcatcgccggcgcgcgcgaagccgatcgtcgcaaggccggcacgtattgcatcgtcatcagcggaaggcggccgtcggatcgggagattgagcgcatcgccgaggccgtggaggaaatccgcgccaccacaaccctcaagatctgctgctgcctcgggctcttgacgcccgcccaggcggatcggctcgcccgggccggcgtgcaccggtacaatcacaacttgaacacgagccgagatcgatatggcgacatttgcaccacccacacctacgacgatcgcgtccggaccctggagcacgtgaaagaggcgggcatctcgccgtgttcgggggtcatcttcggcatgggcgaatcggacgaggaggcggtggacatggcgtttgcgctgaaggagatggacgccgactccatcccgtgcaactttctgaatcccatcccaggcacgccgctcgaaggcatggagaccttgaacccgcggcggtgcctgaagctgctctgcatgatgcgcttcgtgaatccgtcgaaggagatccgcatcgcaggcgggcgagagcgaaacctgcgcagcctgcaggtgctcggcctctacccggccaactccatcttcgtcggggactacttgacgacgcccgggcaggcgccgacggaggactgggccatgatcgaagacctcgggtttgagattgaagaatgcgcgctgtga

SEQ ID NO: 101 - DNA, 1020 bp, Artificial
  Substituion in SEQ ID NO 87
gtgcacgagggggcattgaccatgatgaaaatcgattatcagaccaattggattgacctcgcccgtcgcgtccttgatgggaaaggcgtgactcgcgaggaagccctcgacattctgcggtcgagcgacgacgaactcctagatctcctcgccgccgccttcttgattcgcaggcgctacttcggtaagaaggtcaagctcaacatgatcatcaacgccaagtcgaagatgtgccccgaagactgcgcgtactgctcccagtccgccatctcaaaggccccggtgtccaagtatccgctggtctccaaagaggaaatcatcgccggcgcgcgcgaagccgagcgtcgcaaggccggcacgtattgcatcgtcatcagcggaaggcggccgtcggatcgggagattgagcgcatcgccgaggccgtggaggaaatccgcgccaccacaaccctcaagatctgctgctgcctcgggctcttgacgcccgcccaggcggatcggctcgcccgggccggcgtgcaccggtacaatcacaacttgaacacgagccgagatcgatatggcgacatttgcaccacccacacctacgacgatcgcgtccggaccctggagcacgtgaaagaggcgggcatctcgccgtgttcgggggtcatcttcggcatgggcgaatcggacgaggaggcggtggacatggcgtttgcgctgaaggagatggacgccgactccatcccgtgcaactttctgaatcccatcccaggcacgccgctcgaaggcatggagaccttgaacccgcggcggtgcctgaagctgctctgcatgatgcgcttcgtgaatccgtcgaaggagatccgcatcgcaggcgggcgagagcgaaacctgcgcagcctgcaggtgctcggcctctacccggccaactccatcttcgtcggggactacttgacgacgcccgggcaggcgccgacggaggactgggccatgatcgaagacctcgggtttgagattgaagaatgcgcgctgtga

SEQ ID NO: 102 - DNA, 1020 bp, Artificial
  Substituion in SEQ ID NO 87
gtgcacgagggggcattgaccatgatgaaaatcgattatcagaccaattggattgacctcgcccgtcgcgtccttgatgggcgcggcgtgactcgcgaggaagccctcgacattctgcggtcgagcgacgacgaactcctagatctcctcgccgccgccttcttgattcgcaggcgctacttcggtaagaaggtcaagctcaacatgatcatcaacgccaagtcgaagatgtgccccgaagactgcgcgtactgctcccagtccgccatctcaaaggccccggtgtccaagtatccgctggtctccaaagaggaaatcatcgccggcgcgcgcgaagccgagcgtcgcaaggccggcacgtattgcatcgtcatcagcggaaggcggccgtcggatcgggagattgagcgcatcgccgaggccgtggaggaaatccgcgccaccacaaccctcaagatctgctgctgcctcgggctcttgacgcccgcccaggcggatcggctcgcccgggccggcgtgcaccggtacaatcacaacttgaacacgagccgagatcgatatggcgacatttgcaccacccacacctacgacgatcgcgtccggaccctggagcacgtgaaagaggcgggcatctcgccgtgttcgggggtcatcttcggcatgggcgaatcggacgaggaggcggtggacatggcgtttgcgctgaaggagatggacgccgactccatcccgtgcaactttctgaatcccatcccaggcacgccgctcgaaggcatggagaccttgaacccgcggcggtgcctgaagctgctctgcatgatgcgcttcgtgaatccgtcgaaggagatccgcatcgcaggcgggcgagagaaaaacctgcgcagcctgcaggtgctcggcctctacccggccaactccatcttcgtcggggactacttgacgacgcccgggcaggcgccgacggaggactgggccatgatcgaagacctcgggtttgagattgaagaatgcgcgctgtga

SEQ ID NO: 103 - protein, 268 aa, Alicyclobacillus acidocaldarius
METISVSGRWRNLLHGRRTMKGLFITATDTEVGKTWVTGVLACALRHRGYDVGVCKPIQSGNHLDDPEGDAAKLKRLAGVSDSVSDICLCALPHPVAPQLALKLSGLDLFLDHVLSFVGQAAKRHEWVFVEGAGGVAVPYLSDAWLVDVIQALNFPVLLVARAGLGTINHTILSIEYLNRRGIRVLGVVLNRGSDTYADDAPDKQISFLLERTNSDYIREATGVPVFGVLPNMSSCTVELEIVNAVEQNIDVLGIAKSMNAIYERPNV

SEQ ID NO: 104 - DNA, 807 bp, Alicyclobacillus acidocaldarius
ttggaaaccatctcggtgagcgggagatggaggaacctcttgcacgggagaagaacaatgaaaggactctttatcacagcaactgacacagaagtaggaaaaacatgggtaactggcgttttggcatgtgccttgcgccacaggggttacgacgtcggggtctgcaagcccattcagagtggaaaccacttggacgacccagagggcgatgctgcgaagctgaagcgcttggcaggtgtatcggacagcgtctcggacatctgtctatgtgccctacctcatccggttgcaccacagctagccttaaagttgtccggtttggatctctttcttgatcacgtactctctttcgttggccaggctgcgaagcggcatgagtgggtgtttgtggagggggcaggtggggttgccgttccctatttatccgatgcgtggcttgtagatgtcattcaagctcttaattttccagtcctacttgtggcacgagctgggctgggaacgataaatcacacgatattgtccatcgaatacctgaaccgccgcggaattcgagttttgggcgtcgtcttgaacaggggcagcgatacttacgcggacgatgctccggataaacagatcagttttcttctagaacggacgaatagcgactacattcgcgaagcgacaggtgttccggtatttggtgtgctgccgaatatgtcgtcatgcactgtcgaactagagattgtgaacgctgtcgaacaaaatattgatgtgcttgggatagctaaatccatgaatgctatatatgaaagacccaatgtgtag

SEQ ID NO: 105 - protein, 221 aa, Bacillus weihenstephanensis KBAB4
MSGFFITATDTEVGKTVVTGALAGIFRERGHNVGVYKPLQSGHVASNPEGDAARLKALSGVPTKEDEICPYSIEEPLAPRLAMKRAGRTVMLKEITAHYNELLKEFNSLLVEGAGGLAVPYTEDALVIDFAKELQLPLIVVARPTLGTVNHTVLTISYAKAHGLTVAGVILSGCKECEKERVQENKEMIEELSGVPVLGLLPFLEGEFTKEELLESVKEHI

SEQ ID NO: 106 - protein, 223 aa, Bacillus cereus subsp. cytotoxis NVH 391-98
MSGFFITATDTEVGKTVVTGAIAGGLRKLGHHIGVYKPLQSGHSASHPEGDAARLKMASGVETAVDKICPYSVEEPLAPRLAMQRAGRTVTLADITSYYNELMAEFDSLLVEGAGGLAVPYTEDALVVDFAKQLKLPLIIVARPTLGTVNHTVLTISYAKAKGLQVAGVILSGCKEDEKERVQENKKMIEELSDVPVFGLFPKIREEYTRDELIKAAEESIQI

SEQ ID NO: 107 - protein, 221 aa, Bacillus cereus ATCC 14579
MSGFFITATDTEVGKTVVAGAIAGVFRELGYNVGVYKPLQSGHVASNPEGDAARLKSLSGVPTQENEICPYSIEEPLAPRLAMKRAGRVVKLKEITDYYNGLLKEFNSLFVEGAGGLAVPYTEDALVIDFAKELQLPLIVVARPTLGTVNHTVLTIAYAKAHGLTVAGVILSGCKECEMERVQENKEMIEELSGVPVLGLLPFFAGEFTKEEVLESAKEHI

SEQ ID NO: 108 - protein, 221 aa, Bacillus thuringiensis serovar israelensis ATCC 35646
MSGFFITATDTEVGKTVVAGAIAGVFRELGYNVGVYKPLQSGHVASNPEGDAARLKVLSGVPTQENEICPYSIEEPLAPRLAMKRAGRVVKLKEITDYYNELLKEFNSLFVEGAGGLAVPYTEDALVIDFAKELQLPLIVVARPTLGTVNHTVLTIAYAKAHGLTVAGVILSGCKECEMERVQENKEMIEELSGVPVLGLLPFFEGEFTKEEVLESAKEYI

SEQ ID NO: 109 - protein, 221 aa, Bacillus cereus E33L
MSGFFITATDTEVGKTVVAGALAGVFRELGYNIGVYKPLQSGHVASNPEGDAARLKALSGVPTKEDEICPYSIEEPLAPRLAMKRAGRTVTLKDIIHHYNERLKEFNSLFVEGAGGLAVPYTEDALVIDFAKELQLPLIVVARPTLGTVNHTVLTIAYAKAHGLTVAGVILSGCKECEMERVQENKVMIEELSGVPVLGLLPFFEGEFTKKEVLESAKEYI

SEQ ID NO: 110 - protein, 268 aa, Artificial
  Substituion in SEQ ID NO 103
METISVSGRWRNLLHGRRTMKGLFITATDTEVGKTWVTGVLACALRHRGYDVGVCKPIQSGNHLDDPEGDAAKLKRLAGVSDSVSDICLCALPHPVAPQLALKLSGLDLFLEHVLSFVGQAAKRHEWVFVEGAGGVAVPYLSDAWLVDVIQALNFPVLLVARAGLGTINHTILSIEYLNRRGIRVLGVVLNRGSDTYADDAPDKQISFLLERTNSDYIREATGVPVFGVLPNMSSCTVELEIVNAVEQNIDVLGIAKSMNAIYERPNV

SEQ ID NO: 111 - protein, 268 aa, Artificial
  Substituion in SEQ ID NO 103
METISVSGRWRNLLHGRRTMKGLFITATDTEVGKTWVTGVLACALRHRGYDVGVCKPIQSGNHIDDPEGDAAKLKRLAGVSDSVSDICLCALPHPVAPQLALKLSGLDLFLDHVLSFVGQAAKRHEWVFVEGAGGVAVPYLSDAWLVDVIQALNFPVLLVARAGLGTINHTILSIEYLNRRGIRVLGVVLNRGSDTYADDAPDKQISFLLERTNSDYIREATGVPVFGVLPNMSSCTVELEIVNAVEQNIDVLGIAKSMNAIYERPNV

SEQ ID NO: 112 - protein, 268 aa, Artificial
  Substituion in SEQ ID NO 103
METISVSGRWRNLLHGRRTMKGLFITATDTEVGKTWVTGVLACALRHRGYDVGVCKPIQSGNHLDDPEGDAAKLKRLAGVSDSVSDICLCALPHPVAPQLALKLSGLDLFLDHVLSFVGQAAKRHEWVFVEGAGGVAVPYLSDAWLVDVIQALNFPVLLVARAGLGTINHTILSIEYLNRRGIRVLGVVLNRGSDTYADDAPDKNISFLLERTNSDYIREATGVPVFGVLPNMSSCTVELEIVNAVEQNIDVLGIAKSMNAIYERPNV

SEQ ID NO: 113 - protein, 268 aa, Artificial
  Substituion in SEQ ID NO 103
METISVSGRWRNLLHGRRTMKGLFITATDTEVGKTWVTGVLACALRHRGYDVGVCKPIQSGNHLDDPEGDAAKLKRLAGVSDSVSDICLCALPHPVAPQLALKLSGLDLFLDHVLSFVGQAAKRHEWVFVEGAGGVAVPYLSDAWLVDVIQALNFPVLLVARAGLGTINHTILSIEYINRRGIRVLGVVLNRGSDTYADDAPDKQISFLLERTNSDYIREATGVPVFGVLPNMSSCTVELEIVNAVEQNIDVLGIAKSMNAIYERPNV

SEQ ID NO: 114 - protein, 268 aa, Artificial
  Substituion in SEQ ID NO 103
METISVSGRWRNLLHGRRTMKGLFITATDTEVGKTWVTGVLACALRHRGYDVGVCKPIQSGNHLDDPEGDAAKLKKLAGVSDSVSDICLCALPHPVAPQLALKLSGLDLFLDHVLSFVGQAAKRHEWVFVEGAGGVAVPYLSDAWLVDVIQALNFPVLLVARAGLGTINHTILSIEYLNRRGIRVLGVVLNRGSDTYADDAPDKQISFLLERTNSDYIREATGVPVFGVLPNMSSCTVELEIVNAVEQNIDVLGIAKSMNAIYERPNV

SEQ ID NO: 115 - DNA, 807 bp, Artificial
  Substituion in SEQ ID NO 104
ttggaaaccatctcggtgagcgggagatggaggaacctcttgcacgggagaagaacaatgaaaggactctttatcacagcaactgacacagaagtaggaaaaacatgggtaactggcgttttggcatgtgccttgcgccacaggggttacgacgtcggggtctgcaagcccattcagagtggaaaccacttggacgacccagagggcgatgctgcgaagctgaagcgcttggcaggtgtatcggacagcgtctcggacatctgtctatgtgccctacctcatccggttgcaccacagctagccttaaagttgtccggtttggatctctttcttgaacacgtactctctttcgttggccaggctgcgaagcggcatgagtgggtgtttgtggagggggcaggtggggttgccgttccctatttatccgatgcgtggcttgtagatgtcattcaagctcttaattttccagtcctacttgtggcacgagctgggctgggaacgataaatcacacgatattgtccatcgaatacctgaaccgccgcggaattcgagttttgggcgtcgtcttgaacaggggcagcgatacttacgcggacgatgctccggataaacagatcagttttcttctagaacggacgaatagcgactacattcgcgaagcgacaggtgttccggtatttggtgtgctgccgaatatgtcgtcatgcactgtcgaactagagattgtgaacgctgtcgaacaaaatattgatgtgcttgggatagctaaatccatgaatgctatatatgaaagacccaatgtgtag

SEQ ID NO: 116 - DNA, 807 bp, Artificial
  Substituion in SEQ ID NO 104
ttggaaaccatctcggtgagcgggagatggaggaacctcttgcacgggagaagaacaatgaaaggactctttatcacagcaactgacacagaagtaggaaaaacatgggtaactggcgttttggcatgtgccttgcgccacaggggttacgacgtcggggtctgcaagcccattcagagtggaaaccacattgacgacccagagggcgatgctgcgaagctgaagcgcttggcaggtgtatcggacagcgtctcggacatctgtctatgtgccctacctcatccggttgcaccacagctagccttaaagttgtccggtttggatctctttcttgatcacgtactctctttcgttggccaggctgcgaagcggcatgagtgggtgtttgtggagggggcaggtggggttgccgttccctatttatccgatgcgtggcttgtagatgtcattcaagctcttaattttccagtcctacttgtggcacgagctgggctgggaacgataaatcacacgatattgtccatcgaatacctgaaccgccgcggaattcgagttttgggcgtcgtcttgaacaggggcagcgatacttacgcggacgatgctccggataaacagatcagttttcttctagaacggacgaatagcgactacattcgcgaagcgacaggtgttccggtatttggtgtgctgccgaatatgtcgtcatgcactgtcgaactagagattgtgaacgctgtcgaacaaaatattgatgtgcttgggatagctaaatccatgaatgctatatatgaaagacccaatgtgtag

SEQ ID NO: 117 - DNA, 807 bp, Artificial
  Substituion in SEQ ID NO 104
ttggaaaccatctcggtgagcgggagatggaggaacctcttgcacgggagaagaacaatgaaaggactctttatcacagcaactgacacagaagtaggaaaaacatgggtaactggcgttttggcatgtgccttgcgccacaggggttacgacgtcggggtctgcaagcccattcagagtggaaaccacttggacgacccagagggcgatgctgcgaagctgaagcgcttggcaggtgtatcggacagcgtctcggacatctgtctatgtgccctacctcatccggttgcaccacagctagccttaaagttgtccggtttggatctctttcttgatcacgtactctctttcgttggccaggctgcgaagcggcatgagtgggtgtttgtggagggggcaggtggggttgccgttccctatttatccgatgcgtggcttgtagatgtcattcaagctcttaattttccagtcctacttgtggcacgagctgggctgggaacgataaatcacacgatattgtccatcgaatacctgaaccgccgcggaattcgagttttgggcgtcgtcttgaacaggggcagcgatacttacgcggacgatgctccggataaaaatatcagttttcttctagaacggacgaatagcgactacattcgcgaagcgacaggtgttccggtatttggtgtgctgccgaatatgtcgtcatgcactgtcgaactagagattgtgaacgctgtcgaacaaaatattgatgtgcttgggatagctaaatccatgaatgctatatatgaaagacccaatgtgtag

SEQ ID NO: 118 - DNA, 807 bp, Artificial
  Substituion in SEQ ID NO 104
ttggaaaccatctcggtgagcgggagatggaggaacctcttgcacgggagaagaacaatgaaaggactctttatcacagcaactgacacagaagtaggaaaaacatgggtaactggcgttttggcatgtgccttgcgccacaggggttacgacgtcggggtctgcaagcccattcagagtggaaaccacttggacgacccagagggcgatgctgcgaagctgaagcgcttggcaggtgtatcggacagcgtctcggacatctgtctatgtgccctacctcatccggttgcaccacagctagccttaaagttgtccggtttggatctctttcttgatcacgtactctctttcgttggccaggctgcgaagcggcatgagtgggtgtttgtggagggggcaggtggggttgccgttccctatttatccgatgcgtggcttgtagatgtcattcaagctcttaattttccagtcctacttgtggcacgagctgggctgggaacgataaatcacacgatattgtccatcgaatacattaaccgccgcggaattcgagttttgggcgtcgtcttgaacaggggcagcgatacttacgcggacgatgctccggataaacagatcagttttcttctagaacggacgaatagcgactacattcgcgaagcgacaggtgttccggtatttggtgtgctgccgaatatgtcgtcatgcactgtcgaactagagattgtgaacgctgtcgaacaaaatattgatgtgcttgggatagctaaatccatgaatgctatatatgaaagacccaatgtgtag

SEQ ID NO: 119 - DNA, 807 bp, Artificial
  Substituion in SEQ ID NO 104
ttggaaaccatctcggtgagcgggagatggaggaacctcttgcacgggagaagaacaatgaaaggactctttatcacagcaactgacacagaagtaggaaaaacatgggtaactggcgttttggcatgtgccttgcgccacaggggttacgacgtcggggtctgcaagcccattcagagtggaaaccacttggacgacccagagggcgatgctgcgaagctgaagaaattggcaggtgtatcggacagcgtctcggacatctgtctatgtgccctacctcatccggttgcaccacagctagccttaaagttgtccggtttggatctctttcttgatcacgtactctctttcgttggccaggctgcgaagcggcatgagtgggtgtttgtggagggggcaggtggggttgccgttccctatttatccgatgcgtggcttgtagatgtcattcaagctcttaattttccagtcctacttgtggcacgagctgggctgggaacgataaatcacacgatattgtccatcgaatacctgaaccgccgcggaattcgagttttgggcgtcgtcttgaacaggggcagcgatacttacgcggacgatgctccggataaacagatcagttttcttctagaacggacgaatagcgactacattcgcgaagcgacaggtgttccggtatttggtgtgctgccgaatatgtcgtcatgcactgtcgaactagagattgtgaacgctgtcgaacaaaatattgatgtgcttgggatagctaaatccatgaatgctatatatgaaagacccaatgtgtag

SEQ ID NO: 120 - protein, 390 aa, Alicyclobacillus acidocaldarius
MLKSLESRIVNELFDLREAGRHRSLHSTVVRGARMWLESKEVLHFSSNDYLALSFDHRVREAAQAASHEYGAGATGSRLISGNHPEIEGLEAELASWHGAEASLVFSSGYAANVGVLSALVRSDDVVFSDELNHASLIDGCRMTRARVVVYRHADVQHLEQLMRETPCRGQRFVVSDAVFSMDGDIAPIAELIEIARLFEAVVILDDAHGVGMLGRRGAGTLENFGIVNVDDIVYIGTLSKALGAEGGYVAGRKILIEYLVNRARSFIFSTGLSPMVASSARKARSIAELEDWRRQKVLSLSSALRTSLQQLGYVVRGGETPIVPVIVGDEHSSLTISRHLMSYGIYVPAIRPPSVPEGKCRLRFSLTAAHEMTDVRLVIDVLKDWKPSR

SEQ ID NO: 121 - DNA, 1173 bp, Alicyclobacillus acidocaldarius
atgttgaaatccttagagtcgaggatcgtaaatgagctctttgacttacgtgaggctggaaggcatcgaagcttgcattcaactgtcgtacgaggcgcacgcatgtggctggaatcgaaagaagttttacatttttcctcaaatgattacctcgccctgagttttgaccaccgcgtgcgcgaggctgcccaagcagcttcccatgaatatggggcgggagctactggatctcgacttatctctggaaaccatcccgagatagaggggctggaagcagaattggcgtcttggcatggtgccgaggcaagccttgtattttcctcgggttatgcggccaatgtcggtgtcctttctgctctcgtgaggtccgatgatgtcgtgttttccgatgagctcaatcatgcgagcctaatcgatgggtgtcgtatgacacgagcgagggtcgttgtgtatcgacatgctgatgtgcaacacctggagcagctgatgcgggagacaccatgtcgcggtcagcgcttcgtggtttcagacgctgtcttttcgatggatggggacattgcgcccattgccgaattgattgaaatcgcgcgtctcttcgaggcggtagtgattttggatgacgcgcacggcgtgggaatgttgggtagacggggagcaggaacgcttgaaaactttggtattgtgaacgtcgacgatattgtctacatcggaacgctttctaaggcccttggggcagaagggggttatgtggccggaagaaagatattgattgaatatcttgttaatcgcgcaaggtcgttcattttctcaacaggcttgtcaccgatggttgcgagttcggcccgaaaggctcgaagcattgcggagctcgaggattggcggcggcaaaaagtgctttctctgagcagcgcactccgaacaagtcttcagcagttgggttacgtcgtgcgaggtggggaaacgccgattgtacccgtcattgtaggtgacgaacatagctcactgaccatatccaggcatctcatgagctatggaatctatgtgcctgcgatccggcccccgtctgttcctgaaggaaagtgccgactacgtttcagcctcacggcagcacatgagatgacggatgtaagacttgttatcgacgtcttaaaggattggaaaccatctcggtga

SEQ ID NO: 122 - protein, 379 aa, Geobacillus kaustophilus HTA426
MKTELTVKLHEWEQKAQKRQLRRAEASGATVILNGKPMLNLASNNYLGLADDRRLIEAGCEAMRAYGAGAGASRLVVGNHPLYERAEAALKQWKKAEAALIFNSGYTANIGVLTALIGRDDLVFSDKLNHASLIDGIRLSKAACFRYRHHDIDQLESLLKQSPPAKRKWIVTDAVFSMDGDMAPLEELVELKRRYRAVLLVDEAHSGGVFGPNGEGLLHHFGLEKEEDVIAIGTFSKALGSFGAYVTGEPWLVDYLINSARSLIFTTALPPSVLAANEAAIHIVQAEPKRRERLHALSERFRTKLKRLGFDTGGSETPIVPVIVGPNDRAVAMSEQLQEAGIAAVAIRPPTVPEGTARIRFSITAAMTEEDIDMAVDCI

SEQ ID NO: 123 - protein, 366 aa, Bacillus subtilis subsp. subtilis str. 168
LNERLDRMKEAGVHRNLRSMDGAPVPERNIDGENQTVWSSNNYLGLASDRRLIDAAQTALQQFGTGSSGSRLTTGNSVWHEKLEKKIASFKLTEAALLFSSGYLANVGVLSSLPEKEDVILSDQLNHASMIDGCRLSKADTVVYRHIDMNDLENKLNETQRYQRRFIVTDGVFSMDGTIAPLDQIISLAKRYHAFVVVDDAHATGVLGDSGQGTSEYFGVCPDIVIGTLSKAVGAEGGFAAGSAVFIDFLLNHARTFIFQTAIPPASCAAAHEAFNIIEASREKRQLLFSYISMIRTSLKNMGYVVKGDHTPIIPVVIGDAHKTVLFAEKLQGKGIYAPAIRPPTVAPGESRIRITITSDHSMGDI

SEQ ID NO: 124 - protein, 368 aa, Thermosinus carboxydivorans Nor1
VTEALAEIKRHGLYRQIPDYDPVDAVHVVEDGRRYLMLASNNYLGLTHDPAVREAAAAAALRYGAGSGGARLTTGSHPLFAELERELAAFKGTEAALVFNTGYMANVGIISALAGPGDVIFSDELNHASIIDGCRLARAKVVVYRHADAGHLAECLATTPCAGRRLIVTDGVFSMDGDIAPLDQIVPLAEQYDALVMVDDAHATGVIGPGGRGTTAYFGLKGRVHIEMGTLSKALAAEGGYVAGRRELIDYLVNKARSFIFSTALAPATVAAATAALRELAARPALVATLQANARYLRDRLNEAGFNVASSVTAIIPVIVGEADAAVAMARSLKEAGLIVSAIRPPTVPPGTCRLRLTVSAAHSREDL

SEQ ID NO: 125 - protein, 380 aa, Bacillus sphaericus
MNDRFRRELQVIEEQGLTRKLRLFSTGNESEVVMNGKKFLLFSSNNYLGLATDSRLKKKATEGISKYGTGAGGSRLTTGNFDIHEQLESEIADFKKTEAAIVFSSGYLANVGVISSVMKAGDTIFSDAWNHASIIDGCRLSKAKTIVYEHADMVDLERKLRQSHGDGLKFIVTDGVFSMDGDIAPLPKIVELAKEYKAYIMIDDAHATGVLGNDGCGTADYFGLKDEIDFTVGTLSKAIGAEGGFVSTSSIAKNYLLNNARSFIFQTALSPSAIEAAREGISIIQNEPERRKQLLKNAQYLRLKLEESGFVMKEGETPIISLIIGGSHEAMQFSAKLLDEGVFIPAIRPPTVPKGSSRLRITVMATHTIEQLDMVISKIK

SEQ ID NO: 126 - protein, 374 aa, Kurthia sp. 538-KA26
ELEKIKEGGLYRQLQTVETMSDQGYAMVNGKKMMMFASNNYLGIANDQRLIEASVQATQRFGTGSTGSRLTTGNTIVHEKLEKRLAEFKQTDAAIVLNTGYMANIAALTTLVGSDDLILSDEMNHASIIDGCRLSRAETIIYRHADLLDLEMKLQINTRYRKRIIVTDGVFSMDGDIAPLPGIVELAKRYDALVMVDDAHATGVLGKDGRGTSEHFGLKGKIDIEMGTLSKAVGAEGGYIAGSRSLVDYVLNRARPFVFSTALSAGVVASALTAVDIIQSEPERRVRIRAMSQRLYNELTSLGYTVSGGETPILAIICGEPEQAMFLSKELHKHGIYAPAIRSPTVPLGTSRIRLTLMATHQEEQMNHVIDVFR

SEQ ID NO: 127 - protein, 390 aa, Artificial
  Substituion in SEQ ID NO 120
MLKSLESRIVNELFDLREAGRHRSLHSTVVKGARMWLESKEVLHFSSNDYLALSFDHRVREAAQAASHEYGAGATGSRLISGNHPEIEGLEAELASWHGAEASLVFSSGYAANVGVLSALVRSDDVVFSDELNHASLIDGCRMTRARVVVYRHADVQHLEQLMRETPCRGQRFVVSDAVFSMDGDIAPIAELIEIARLFEAVVILDDAHGVGMLGRRGAGTLENFGIVNVDDIVYIGTLSKALGAEGGYVAGRKILIEYLVNRARSFIFSTGLSPMVASSARKARSIAELEDWRRQKVLSLSSALRTSLQQLGYVVRGGETPIVPVIVGDEHSSLTISRHLMSYGIYVPAIRPPSVPEGKCRLRFSLTAAHEMTDVRLVIDVLKDWKPSR

SEQ ID NO: 128 - protein, 390 aa, Artificial
  Substituion in SEQ ID NO 120
MLKSLESRIVNELFDLREAGRHRSLHSTVVRGARMWLESKEVLHFSSNDYLALSFDHRVREAAQAASHEYGAGATGSRLISGNHPEIEGLEAELASWHGAEASLVFSSGYAANVGVLSALVRSDDVVFSDELNHASLIDGCRMTRARVVVYRHADVQHLEQLMRETPCRGQRFVVSDAVFSMDGDIAPIAELIEIARLFEAVVILDDAHGVGMLGRRGAGTLENFGIVNVDDIVYIGTLSKALGAEGGYVAGRKILIEYLVNRARSFIFSTGLSPMVASSARKARSIAELEDWRRQKVLSLSSALRTSLQQLGYVVKGGETPIVPVIVGDEHSSLTISRHLMSYGIYVPAIRPPSVPEGKCRLRFSLTAAHEMTDVRLVIDVLKDWKPSR

SEQ ID NO: 129 - protein, 390 aa, Artificial
  Substituion in SEQ ID NO 120
MLKSLESRIVNELFDLREAGRHRSLHSTVVRGARMWLESKEVLHFSSNDYLALSFDHRVREAAQAASHEYGAGATGSRLISGNHPEIEGLEAELASWHGAEASLVFSSGYAANVGVLSALVRSDDVVFSDELNHASLIDGCRMTRARVVVYRHADVQHLEQLMRDTPCRGQRFVVSDAVFSMDGDIAPIAELIEIARLFEAVVILDDAHGVGMLGRRGAGTLENFGIVNVDDIVYIGTLSKALGAEGGYVAGRKILIEYLVNRARSFIFSTGLSPMVASSARKARSIAELEDWRRQKVLSLSSALRTSLQQLGYVVRGGETPIVPVIVGDEHSSLTISRHLMSYGIYVPAIRPPSVPEGKCRLRFSLTAAHEMTDVRLVIDVLKDWKPSR

SEQ ID NO: 130 - protein, 390 aa, Artificial
  Substituion in SEQ ID NO 120
MLKSLESRIVNELFDLREAGRHRSLHSTVVRGARMWLESKEVLHFSSNDYLALSFDHRVREAAQAASHEYGAGATGSRLISGNHPEIEGLEAELASWHGAEASLVFSSGYAANVGVLSALVRSDDVVFSDELNHASLIDGCRMTRARVVVYRHADVQHLEQLMRETPCRGQRFVVSDAVFSMDGDIAPIAELIEIARLFEAVVILDDAHGVGMLGRRGAGTLENFGIVNVDDIVYIGTLSKALGADGGYVAGRKILIEYLVNRARSFIFSTGLSPMVASSARKARSIAELEDWRRQKVLSLSSALRTSLQQLGYVVRGGETPIVPVIVGDEHSSLTISRHLMSYGIYVPAIRPPSVPEGKCRLRFSLTAAHEMTDVRLVIDVLKDWKPSR

SEQ ID NO: 131 - protein, 390 aa, Artificial
  Substituion in SEQ ID NO 120
MLKSLESRIVNDLFDLREAGRHRSLHSTVVRGARMWLESKEVLHFSSNDYLALSFDHRVREAAQAASHEYGAGATGSRLISGNHPEIEGLEAELASWHGAEASLVFSSGYAANVGVLSALVRSDDVVFSDELNHASLIDGCRMTRARVVVYRHADVQHLEQLMRETPCRGQRFVVSDAVFSMDGDIAPIAELIEIARLFEAVVILDDAHGVGMLGRRGAGTLENFGIVNVDDIVYIGTLSKALGAEGGYVAGRKILIEYLVNRARSFIFSTGLSPMVASSARKARSIAELEDWRRQKVLSLSSALRTSLQQLGYVVRGGETPIVPVIVGDEHSSLTISRHLMSYGIYVPAIRPPSVPEGKCRLRFSLTAAHEMTDVRLVIDVLKDWKPSR

SEQ ID NO: 132 - DNA, 1173 bp, Artificial
  Substituion in SEQ ID NO 121
atgttgaaatccttagagtcgaggatcgtaaatgagctctttgacttacgtgaggctggaaggcatcgaagcttgcattcaactgtcgtaaaaggcgcacgcatgtggctggaatcgaaagaagttttacatttttcctcaaatgattacctcgccctgagttttgaccaccgcgtgcgcgaggctgcccaagcagcttcccatgaatatggggcgggagctactggatctcgacttatctctggaaaccatcccgagatagaggggctggaagcagaattggcgtcttggcatggtgccgaggcaagccttgtattttcctcgggttatgcggccaatgtcggtgtcctttctgctctcgtgaggtccgatgatgtcgtgttttccgatgagctcaatcatgcgagcctaatcgatgggtgtcgtatgacacgagcgagggtcgttgtgtatcgacatgctgatgtgcaacacctggagcagctgatgcgggagacaccatgtcgcggtcagcgcttcgtggtttcagacgctgtcttttcgatggatggggacattgcgcccattgccgaattgattgaaatcgcgcgtctcttcgaggcggtagtgattttggatgacgcgcacggcgtgggaatgttgggtagacggggagcaggaacgcttgaaaactttggtattgtgaacgtcgacgatattgtctacatcggaacgctttctaaggcccttggggcagaagggggttatgtggccggaagaaagatattgattgaatatcttgttaatcgcgcaaggtcgttcattttctcaacaggcttgtcaccgatggttgcgagttcggcccgaaaggctcgaagcattgcggagctcgaggattggcggcggcaaaaagtgctttctctgagcagcgcactccgaacaagtcttcagcagttgggttacgtcgtgcgaggtggggaaacgccgattgtacccgtcattgtaggtgacgaacatagctcactgaccatatccaggcatctcatgagctatggaatctatgtgcctgcgatccggcccccgtctgttcctgaaggaaagtgccgactacgtttcagcctcacggcagcacatgagatgacggatgtaagacttgttatcgacgtcttaaaggattggaaaccatctcggtga

SEQ ID NO: 133 - DNA, 1173 bp, Artificial
  Substituion in SEQ ID NO 121
atgttgaaatccttagagtcgaggatcgtaaatgagctctttgacttacgtgaggctggaaggcatcgaagcttgcattcaactgtcgtacgaggcgcacgcatgtggctggaatcgaaagaagttttacatttttcctcaaatgattacctcgccctgagttttgaccaccgcgtgcgcgaggctgcccaagcagcttcccatgaatatggggcgggagctactggatctcgacttatctctggaaaccatcccgagatagaggggctggaagcagaattggcgtcttggcatggtgccgaggcaagccttgtattttcctcgggttatgcggccaatgtcggtgtcctttctgctctcgtgaggtccgatgatgtcgtgttttccgatgagctcaatcatgcgagcctaatcgatgggtgtcgtatgacacgagcgagggtcgttgtgtatcgacatgctgatgtgcaacacctggagcagctgatgcgggagacaccatgtcgcggtcagcgcttcgtggtttcagacgctgtcttttcgatggatggggacattgcgcccattgccgaattgattgaaatcgcgcgtctcttcgaggcggtagtgattttggatgacgcgcacggcgtgggaatgttgggtagacggggagcaggaacgcttgaaaactttggtattgtgaacgtcgacgatattgtctacatcggaacgctttctaaggcccttggggcagaagggggttatgtggccggaagaaagatattgattgaatatcttgttaatcgcgcaaggtcgttcattttctcaacaggcttgtcaccgatggttgcgagttcggcccgaaaggctcgaagcattgcggagctcgaggattggcggcggcaaaaagtgctttctctgagcagcgcactccgaacaagtcttcagcagttgggttacgtcgtgaaaggtggggaaacgccgattgtacccgtcattgtaggtgacgaacatagctcactgaccatatccaggcatctcatgagctatggaatctatgtgcctgcgatccggcccccgtctgttcctgaaggaaagtgccgactacgtttcagcctcacggcagcacatgagatgacggatgtaagacttgttatcgacgtcttaaaggattggaaaccatctcggtga

SEQ ID NO: 134 - DNA, 1173 bp, Artificial
  Substituion in SEQ ID NO 121
atgttgaaatccttagagtcgaggatcgtaaatgagctctttgacttacgtgaggctggaaggcatcgaagcttgcattcaactgtcgtacgaggcgcacgcatgtggctggaatcgaaagaagttttacatttttcctcaaatgattacctcgccctgagttttgaccaccgcgtgcgcgaggctgcccaagcagcttcccatgaatatggggcgggagctactggatctcgacttatctctggaaaccatcccgagatagaggggctggaagcagaattggcgtcttggcatggtgccgaggcaagccttgtattttcctcgggttatgcggccaatgtcggtgtcctttctgctctcgtgaggtccgatgatgtcgtgttttccgatgagctcaatcatgcgagcctaatcgatgggtgtcgtatgacacgagcgagggtcgttgtgtatcgacatgctgatgtgcaacacctggagcagctgatgcgggatacaccatgtcgcggtcagcgcttcgtggtttcagacgctgtcttttcgatggatggggacattgcgcccattgccgaattgattgaaatcgcgcgtctcttcgaggcggtagtgattttggatgacgcgcacggcgtgggaatgttgggtagacggggagcaggaacgcttgaaaactttggtattgtgaacgtcgacgatattgtctacatcggaacgctttctaaggcccttggggcagaagggggttatgtggccggaagaaagatattgattgaatatcttgttaatcgcgcaaggtcgttcattttctcaacaggcttgtcaccgatggttgcgagttcggcccgaaaggctcgaagcattgcggagctcgaggattggcggcggcaaaaagtgctttctctgagcagcgcactccgaacaagtcttcagcagttgggttacgtcgtgcgaggtggggaaacgccgattgtacccgtcattgtaggtgacgaacatagctcactgaccatatccaggcatctcatgagctatggaatctatgtgcctgcgatccggcccccgtctgttcctgaaggaaagtgccgactacgtttcagcctcacggcagcacatgagatgacggatgtaagacttgttatcgacgtcttaaaggattggaaaccatctcggtga

SEQ ID NO: 135 - DNA, 1173 bp, Artificial
  Substituion in SEQ ID NO 121
atgttgaaatccttagagtcgaggatcgtaaatgagctctttgacttacgtgaggctggaaggcatcgaagcttgcattcaactgtcgtacgaggcgcacgcatgtggctggaatcgaaagaagttttacatttttcctcaaatgattacctcgccctgagttttgaccaccgcgtgcgcgaggctgcccaagcagcttcccatgaatatggggcgggagctactggatctcgacttatctctggaaaccatcccgagatagaggggctggaagcagaattggcgtcttggcatggtgccgaggcaagccttgtattttcctcgggttatgcggccaatgtcggtgtcctttctgctctcgtgaggtccgatgatgtcgtgttttccgatgagctcaatcatgcgagcctaatcgatgggtgtcgtatgacacgagcgagggtcgttgtgtatcgacatgctgatgtgcaacacctggagcagctgatgcgggagacaccatgtcgcggtcagcgcttcgtggtttcagacgctgtcttttcgatggatggggacattgcgcccattgccgaattgattgaaatcgcgcgtctcttcgaggcggtagtgattttggatgacgcgcacggcgtgggaatgttgggtagacggggagcaggaacgcttgaaaactttggtattgtgaacgtcgacgatattgtctacatcggaacgctttctaaggcccttggggcagatgggggttatgtggccggaagaaagatattgattgaatatcttgttaatcgcgcaaggtcgttcattttctcaacaggcttgtcaccgatggttgcgagttcggcccgaaaggctcgaagcattgcggagctcgaggattggcggcggcaaaaagtgctttctctgagcagcgcactccgaacaagtcttcagcagttgggttacgtcgtgcgaggtggggaaacgccgattgtacccgtcattgtaggtgacgaacatagctcactgaccatatccaggcatctcatgagctatggaatctatgtgcctgcgatccggcccccgtctgttcctgaaggaaagtgccgactacgtttcagcctcacggcagcacatgagatgacggatgtaagacttgttatcgacgtcttaaaggattggaaaccatctcggtga

SEQ ID NO: 136 - DNA, 1173 bp, Artificial
  Substituion in SEQ ID NO 121
atgttgaaatccttagagtcgaggatcgtaaatgatctctttgacttacgtgaggctggaaggcatcgaagcttgcattcaactgtcgtacgaggcgcacgcatgtggctggaatcgaaagaagttttacatttttcctcaaatgattacctcgccctgagttttgaccaccgcgtgcgcgaggctgcccaagcagcttcccatgaatatggggcgggagctactggatctcgacttatctctggaaaccatcccgagatagaggggctggaagcagaattggcgtcttggcatggtgccgaggcaagccttgtattttcctcgggttatgcggccaatgtcggtgtcctttctgctctcgtgaggtccgatgatgtcgtgttttccgatgagctcaatcatgcgagcctaatcgatgggtgtcgtatgacacgagcgagggtcgttgtgtatcgacatgctgatgtgcaacacctggagcagctgatgcgggagacaccatgtcgcggtcagcgcttcgtggtttcagacgctgtcttttcgatggatggggacattgcgcccattgccgaattgattgaaatcgcgcgtctcttcgaggcggtagtgattttggatgacgcgcacggcgtgggaatgttgggtagacggggagcaggaacgcttgaaaactttggtattgtgaacgtcgacgatattgtctacatcggaacgctttctaaggcccttggggcagaagggggttatgtggccggaagaaagatattgattgaatatcttgttaatcgcgcaaggtcgttcattttctcaacaggcttgtcaccgatggttgcgagttcggcccgaaaggctcgaagcattgcggagctcgaggattggcggcggcaaaaagtgctttctctgagcagcgcactccgaacaagtcttcagcagttgggttacgtcgtgcgaggtggggaaacgccgattgtacccgtcattgtaggtgacgaacatagctcactgaccatatccaggcatctcatgagctatggaatctatgtgcctgcgatccggcccccgtctgttcctgaaggaaagtgccgactacgtttcagcctcacggcagcacatgagatgacggatgtaagacttgttatcgacgtcttaaaggattggaaaccatctcggtga

SEQ ID NO: 137 - protein, 297 aa, Alicyclobacillus acidocaldarius
MDVASQVFLDGEFVSSDAASVSVFDHGLLYGDGVFEGIRAYDGNVFRLKPHMDRLYRSAKSILLEIPYTQDELTELVCETVRRNHLSSAYIRLVVTRGSGDLGLNPYNCAKARVFIIAEQLSMFPKALYEQGIRAITAATRRTRGDVLNPKIKSLNYLNNILIKMEAIHAGANEAIVLNHEGYVVEGSGENIFLVRDGVLITPPAYLGALEGITRQAVIDLAPALGLEVRQEPFTQHDVYVADEVFLTGTAAEIVPVVEVDRRAIGHGVPGPVTKRVHAAFQEIVRADGVRIEGARV

SEQ ID NO: 138 - DNA, 894 bp, Alicyclobacillus acidocaldarius
ttggacgtggcatcacaggtttttcttgacggcgaatttgtctccagcgacgcagccagcgtgtcagtgttcgatcacggcctcctgtacggcgatggcgtcttcgaaggaatccgcgcatatgacgggaacgtattccgcctcaagccgcacatggaccgactttatcgttcggccaagtccattcttctcgagattccgtatacgcaggacgaattgacggaactcgtgtgcgagaccgtccggcgcaatcatctgtcctcggcgtacatccgcctcgtggtcacgcgcggaagtggggacctggggctgaatccatacaactgcgcgaaggcccgcgtcttcatcatcgcggagcagctctcgatgtttccaaaggcgctgtacgagcagggcattcgcgccatcacggctgcaacgcgccgcacgcggggcgacgtgctcaatccgaagatcaagtctctcaattatctcaacaatattctgattaaaatggaagccattcatgcaggtgccaatgaagcgattgtgctcaaccacgagggctatgtggtggagggttccggcgagaacatcttcctcgtgcgcgatggcgtcctcatcaccccgccggcttatctcggggccctcgagggcatcacgcgccaggcggtcatcgacttggctcctgcgctcggcctcgaggttcgacaggaaccgttcacccagcacgacgtgtacgtggcggacgaggtgtttctcacaggcacagccgcggagattgtcccggtggtcgaggtggaccggcgcgccattggtcacggcgttccagggccggtgacgaagcgggtgcacgcggcgttccaggaaatcgtgcgcgcggacggcgtgcgcatcgaaggggctcgcgtctga

SEQ ID NO: 139 - protein, 286 aa, Geobacillus thermodenitrificans NG80-2
IFLNGEFVTKENAKISVYDHGFLYGDGVFEGIRVYSGNVFRLEEHIDRLYNSAKSIMLNIPYTKDEMINHVLETVRRNGYQDAYIRLVVSRGVGDLGLDPYKCKSPQVVIIVEPLALFPKHLYETGIEVVTVATRRNRSDVLSPKVKSLNYLNNVLVKIEAHLANVSEALILNDQGYVAEGSGDNIFIVKNGVVYTPPGYVGALEGITRQAIIEIAEELGYTVKEEPFTRHDVYVADEVFLTGTAAEVISVIKVDGRTIGDGTPGPHTKRLLEEFRRRVIAEGVKV

SEQ ID NO: 140 - protein, 286 aa, Geobacillus kaustophilus HTA426
IFLNGEFVTKENAKISVYDHGFLYGDGVFEGIRVYSGNVFRLEEHIDRLYNSAKSILLDIPYTKEEMIGHVLETIRRNGYQDAYIRLVVSRGVGDLGLDPYKCKTPQIVIIVEPLALFPKHLYETGIEVVTVATRRNRSDVLSPKVKSLNYLNNVLVKIEAHLANVSEALILNDQGYVAEGSGDNVFIIKNGVIYTPPGYVGALEGITRQAIIEIAEDLGYTVKEEPFTRHDVYVADEVFLTGTAAEVISVIKVDGRTIGDGTPGPHTKRLLEEFRRRVVVEGVKV

SEQ ID NO: 141 - protein, 286 aa, Bacillus sp. NRRL B-14911
IFLNGEFVTKENAKISVYDHGFLYGDGIFEGIRVYSGNIFRMKEHMDRLYRSAKSILLTMPYTEEELTDIIVATVEKNLYEDAYIRVVVSRGVGDLGLDPYNCKKANVVVIVEPLSIFPKELYETGLEIVTVATRRNRPDVLSPKVKSLNYLNNVLVRIEARLANVSEALMLNDQGYVAEGSADNVFIIKDKCFYTPPGYVGALEGITRNAVMEIARELGYEVKEEPFTRHDVYTADEVFLTGTAAEVIAVVKVDGRTIGEGYPGAHTKELLVKFRERVVSEGVKV

SEQ ID NO: 142 - protein, 288 aa, Bacillus cereus subsp. cytotoxis NVH 391-98
IYMNGELVEKEKAVVSVYDHGFLYGDGVFEGIRSYGGNVFCLKEHVKRLYESAKSILLTIPMTVEEMEKAVVQTLQKNGYADAYIRLIVSRGKGDLGLDPRSCEKPSVIIIAEQLKLFPQEFYDNGLSVVSVASRRNMPDALDPRIKSMNYLNNVLVKIEAAQAGALEALMLNQQGYVCEGSGDNVFVVKDGKVVTPPSYLGALEGVTRNSVIELCDKLGIPCEERPFTRHDVYVADEVFLTGTAAELIPVVKVDAREIGDGKPGEVTKQLTEAFKRLTRERGVRVPG

SEQ ID NO: 143 - protein, 286 aa, Bacillus licheniformis ATCC 14580
IFLNDKLVKKEDAKISVYDHGFLYGDGVFEGIRVYDGNIFRMQEHMDRLYDSARSIMLEIPYPQEELTQHVLKTVEKNGLKDAYIRLVVSRGAGDLGLDPNNCSNPSVIIIVEPLAIFPKHLYETGIDIVTVPTRRNRPDVLSPKVKSLNYLNNILVRIEAHMAGVTEALMLNDQGYVAEGSADNVFIYKNGKLLTPPGYIGALEGITRNAIIEIARELGYEVKEEPFTRHDVYTAEEVFLTGTAAEVIAVVKVDGRKIGDGKPGVHTNRMLEKFRERVVREGLKV

SEQ ID NO: 144 - protein, 297 aa, Artificial
  Substituion in SEQ ID NO 137
MDVASQVFLDGEFVSSDAASVSVFDHGLLYGDGVFEGIRAYDGNVFRLKPHMDRLYRSAKSILLEIPYTNDELTELVCETVRRNHLSSAYIRLVVTRGSGDLGLNPYNCAKARVFIIAEQLSMFPKALYEQGIRAITAATRRTRGDVLNPKIKSLNYLNNILIKMEAIHAGANEAIVLNHEGYVVEGSGENIFLVRDGVLITPPAYLGALEGITRQAVIDLAPALGLEVRQEPFTQHDVYVADEVFLTGTAAEIVPVVEVDRRAIGHGVPGPVTKRVHAAFQEIVRADGVRIEGARV

SEQ ID NO: 145 - protein, 297 aa, Artificial
  Substituion in SEQ ID NO 137
MDVASQVFLDGEFVSSDAASVSVFDHGLLYGDGVFEGIRAYDGNVFRLKPHMDRLYKSAKSILLEIPYTQDELTELVCETVRRNHLSSAYIRLVVTRGSGDLGLNPYNCAKARVFIIAEQLSMFPKALYEQGIRAITAATRRTRGDVLNPKIKSLNYLNNILIKMEAIHAGANEAIVLNHEGYVVEGSGENIFLVRDGVLITPPAYLGALEGITRQAVIDLAPALGLEVRQEPFTQHDVYVADEVFLTGTAAEIVPVVEVDRRAIGHGVPGPVTKRVHAAFQEIVRADGVRIEGARV

SEQ ID NO: 146 - protein, 297 aa, Artificial
  Substituion in SEQ ID NO 137
MDVASQVFLDGEFVSSDAASVSVFDHGLLYGDGVFEGIRAYDGNVFRLKPHMDRLYRSAKSILLEIPYTQDELTELVCETVRRNHLSSAYIRLVVTRGSGDLGLNPYNCAKARVFIIAEQLSMFPKALYEQGIRAITAATRRTRGDVLNPKIKSLNYLNNILIKMEAIHAGANEAIVLNHEGYVVEGSGENIFLVRDGVLITPPAYLGALEGITRQAVIDLAPALGIEVRQEPFTQHDVYVADEVFLTGTAAEIVPVVEVDRRAIGHGVPGPVTKRVHAAFQEIVRADGVRIEGARV

SEQ ID NO: 147 - protein, 297 aa, Artificial
  Substituion in SEQ ID NO 137
MDVASQVFLDGEFVSSDAASVSVFDHGLLYGDGVFEGIRAYDGNVFRLKPHMDRLYRSAKSILLEIPYTQDELTELVCETVRRNHLSSAYIRLVVTRGSGDLGLNPYNCAKARVFIIAEQLSMFPKALYEQGIRAITAATRRTRGDVLNPKIKSLNYLNNILIKMEAIHAGANEAIVLNHEGYVVEGSGENIFLVRDGVLITPPAYLGALEGITRQAVIDLAPALGLEVRQEPFTQHDVYVADEVFLTGTAAEIVPVVEVDRRAIGHGVPGPVTKRVHAAFQEIVRADGVRIEGARI

SEQ ID NO: 148 - protein, 297 aa, Artificial
  Substituion in SEQ ID NO 137
MDVASQVFLDGEFVSSDAASVSVFDHGLLYGDGVFEGIRAYDGNVFRLKPHMDRLYRSAKSILLEIPYTQDELTELVCETVRRNHLSSAYIRLVVTRGSGDLGLNPYNCAKARVFIIAEQLSMFPKALYEQGIRAITAATRRTRGDVLNPKIKSLNYLNNILIKMEAIHAGANEAIVLNHEGYVVEGSGENIFLVRDGVLITPPAYLGALEGITRQAVIDLAPALGLEVRQEPFTQHDVYVADEVFLTGTAAEIVPVVEVDRRAIGHGVPGPVTKRVHAAFQEIVRAEGVRIEGARV

SEQ ID NO: 149 - DNA, 894 bp, Artificial
  Substituion in SEQ ID NO 138
ttggacgtggcatcacaggtttttcttgacggcgaatttgtctccagcgacgcagccagcgtgtcagtgttcgatcacggcctcctgtacggcgatggcgtcttcgaaggaatccgcgcatatgacgggaacgtattccgcctcaagccgcacatggaccgactttatcgttcggccaagtccattcttctcgagattccgtatacgaatgacgaattgacggaactcgtgtgcgagaccgtccggcgcaatcatctgtcctcggcgtacatccgcctcgtggtcacgcgcggaagtggggacctggggctgaatccatacaactgcgcgaaggcccgcgtcttcatcatcgcggagcagctctcgatgtttccaaaggcgctgtacgagcagggcattcgcgccatcacggctgcaacgcgccgcacgcggggcgacgtgctcaatccgaagatcaagtctctcaattatctcaacaatattctgattaaaatggaagccattcatgcaggtgccaatgaagcgattgtgctcaaccacgagggctatgtggtggagggttccggcgagaacatcttcctcgtgcgcgatggcgtcctcatcaccccgccggcttatctcggggccctcgagggcatcacgcgccaggcggtcatcgacttggctcctgcgctcggcctcgaggttcgacaggaaccgttcacccagcacgacgtgtacgtggcggacgaggtgtttctcacaggcacagccgcggagattgtcccggtggtcgaggtggaccggcgcgccattggtcacggcgttccagggccggtgacgaagcgggtgcacgcggcgttccaggaaatcgtgcgcgcggacggcgtgcgcatcgaaggggctcgcgtctga

SEQ ID NO: 150 - DNA, 894 bp, Artificial
  Substituion in SEQ ID NO 138
ttggacgtggcatcacaggtttttcttgacggcgaatttgtctccagcgacgcagccagcgtgtcagtgttcgatcacggcctcctgtacggcgatggcgtcttcgaaggaatccgcgcatatgacgggaacgtattccgcctcaagccgcacatggaccgactttataaatcggccaagtccattcttctcgagattccgtatacgcaggacgaattgacggaactcgtgtgcgagaccgtccggcgcaatcatctgtcctcggcgtacatccgcctcgtggtcacgcgcggaagtggggacctggggctgaatccatacaactgcgcgaaggcccgcgtcttcatcatcgcggagcagctctcgatgtttccaaaggcgctgtacgagcagggcattcgcgccatcacggctgcaacgcgccgcacgcggggcgacgtgctcaatccgaagatcaagtctctcaattatctcaacaatattctgattaaaatggaagccattcatgcaggtgccaatgaagcgattgtgctcaaccacgagggctatgtggtggagggttccggcgagaacatcttcctcgtgcgcgatggcgtcctcatcaccccgccggcttatctcggggccctcgagggcatcacgcgccaggcggtcatcgacttggctcctgcgctcggcctcgaggttcgacaggaaccgttcacccagcacgacgtgtacgtggcggacgaggtgtttctcacaggcacagccgcggagattgtcccggtggtcgaggtggaccggcgcgccattggtcacggcgttccagggccggtgacgaagcgggtgcacgcggcgttccaggaaatcgtgcgcgcggacggcgtgcgcatcgaaggggctcgcgtctga

SEQ ID NO: 151 - DNA, 894 bp, Artificial
  Substituion in SEQ ID NO 138
ttggacgtggcatcacaggtttttcttgacggcgaatttgtctccagcgacgcagccagcgtgtcagtgttcgatcacggcctcctgtacggcgatggcgtcttcgaaggaatccgcgcatatgacgggaacgtattccgcctcaagccgcacatggaccgactttatcgttcggccaagtccattcttctcgagattccgtatacgcaggacgaattgacggaactcgtgtgcgagaccgtccggcgcaatcatctgtcctcggcgtacatccgcctcgtggtcacgcgcggaagtggggacctggggctgaatccatacaactgcgcgaaggcccgcgtcttcatcatcgcggagcagctctcgatgtttccaaaggcgctgtacgagcagggcattcgcgccatcacggctgcaacgcgccgcacgcggggcgacgtgctcaatccgaagatcaagtctctcaattatctcaacaatattctgattaaaatggaagccattcatgcaggtgccaatgaagcgattgtgctcaaccacgagggctatgtggtggagggttccggcgagaacatcttcctcgtgcgcgatggcgtcctcatcaccccgccggcttatctcggggccctcgagggcatcacgcgccaggcggtcatcgacttggctcctgcgctcggcattgaggttcgacaggaaccgttcacccagcacgacgtgtacgtggcggacgaggtgtttctcacaggcacagccgcggagattgtcccggtggtcgaggtggaccggcgcgccattggtcacggcgttccagggccggtgacgaagcgggtgcacgcggcgttccaggaaatcgtgcgcgcggacggcgtgcgcatcgaaggggctcgcgtctga

SEQ ID NO: 152 - DNA, 894 bp, Artificial
  Substituion in SEQ ID NO 138
ttggacgtggcatcacaggtttttcttgacggcgaatttgtctccagcgacgcagccagcgtgtcagtgttcgatcacggcctcctgtacggcgatggcgtcttcgaaggaatccgcgcatatgacgggaacgtattccgcctcaagccgcacatggaccgactttatcgttcggccaagtccattcttctcgagattccgtatacgcaggacgaattgacggaactcgtgtgcgagaccgtccggcgcaatcatctgtcctcggcgtacatccgcctcgtggtcacgcgcggaagtggggacctggggctgaatccatacaactgcgcgaaggcccgcgtcttcatcatcgcggagcagctctcgatgtttccaaaggcgctgtacgagcagggcattcgcgccatcacggctgcaacgcgccgcacgcggggcgacgtgctcaatccgaagatcaagtctctcaattatctcaacaatattctgattaaaatggaagccattcatgcaggtgccaatgaagcgattgtgctcaaccacgagggctatgtggtggagggttccggcgagaacatcttcctcgtgcgcgatggcgtcctcatcaccccgccggcttatctcggggccctcgagggcatcacgcgccaggcggtcatcgacttggctcctgcgctcggcctcgaggttcgacaggaaccgttcacccagcacgacgtgtacgtggcggacgaggtgtttctcacaggcacagccgcggagattgtcccggtggtcgaggtggaccggcgcgccattggtcacggcgttccagggccggtgacgaagcgggtgcacgcggcgttccaggaaatcgtgcgcgcggacggcgtgcgcatcgaaggggctcgcatttga

SEQ ID NO: 153 - DNA, 894 bp, Artificial
  Substituion in SEQ ID NO 138
ttggacgtggcatcacaggtttttcttgacggcgaatttgtctccagcgacgcagccagcgtgtcagtgttcgatcacggcctcctgtacggcgatggcgtcttcgaaggaatccgcgcatatgacgggaacgtattccgcctcaagccgcacatggaccgactttatcgttcggccaagtccattcttctcgagattccgtatacgcaggacgaattgacggaactcgtgtgcgagaccgtccggcgcaatcatctgtcctcggcgtacatccgcctcgtggtcacgcgcggaagtggggacctggggctgaatccatacaactgcgcgaaggcccgcgtcttcatcatcgcggagcagctctcgatgtttccaaaggcgctgtacgagcagggcattcgcgccatcacggctgcaacgcgccgcacgcggggcgacgtgctcaatccgaagatcaagtctctcaattatctcaacaatattctgattaaaatggaagccattcatgcaggtgccaatgaagcgattgtgctcaaccacgagggctatgtggtggagggttccggcgagaacatcttcctcgtgcgcgatggcgtcctcatcaccccgccggcttatctcggggccctcgagggcatcacgcgccaggcggtcatcgacttggctcctgcgctcggcctcgaggttcgacaggaaccgttcacccagcacgacgtgtacgtggcggacgaggtgtttctcacaggcacagccgcggagattgtcccggtggtcgaggtggaccggcgcgccattggtcacggcgttccagggccggtgacgaagcgggtgcacgcggcgttccaggaaatcgtgcgcgcggaaggcgtgcgcatcgaaggggctcgcgtctga

SEQ ID NO: 154 - protein, 557 aa, Alicyclobacillus acidocaldarius
MRSDMIKKGVDRAPHRALLYATGVKPRDLSKPFIGVCNSYVDIVPGHVHLREFAEVVKDAIRQAGGVPFEFNTIGVDDGIAMGHIGMRYSLASRELIADSAETMINAHWFDGVFFIPNCDKITPGMLMAAVRCNVPAVFVSGGPMEAGRSRTGRPLSLSSVFEGVGQYMSGQISEDDLLDLERNACPTCGSCSGMFTANSMNCIMEMLGIALPGNGTLVATSKERHELIYEAAKHLIRMVEQDIRPRDIITREAIDDAFALDMAMGGSTNTVLHLMAIAHEAGIDYSLSDINEIAKRVPYLAKISPASEYSIQDVHRAGGVSAIIRELCEHTDAVHPDRITVTGKTLYEQVKDAKILDERVIRPASNPYSREGGLSILFGNLAPDGAVLKVGAVDPDIQRFVGRAICFNSQDEAMEGINSGKVQPGHVVVIRYEGPKGGPGMPEMLAPTSSIVGRGLGREVALITDGRFSGATRGICVGHISPEAGVGGPIALVEDGDEIEIDIPNRAITLKVSDEELAARRARYQPPAKEKLTGYLARYQKLVTSANTGAVLTVDA

SEQ ID NO: 155 - DNA, 1674 bp, Alicyclobacillus acidocaldarius
atgagaagcgacatgatcaaaaagggcgtggaccgggcgccgcacagggccctgctctatgccacgggcgtcaaacccagggatctgtccaaaccgtttatcggcgtgtgcaactcgtacgtcgacatcgttccgggccacgttcatctccgcgaattcgcggaagtcgtgaaagatgccatccgccaggcaggtggcgtcccgttcgaattcaacaccatcggtgtggacgacgggatcgccatggggcacatcggcatgcggtattcgctcgcgagccgcgagctcatcgccgattcggccgagacgatgatcaacgcccactggttcgacggcgtctttttcatccccaactgtgacaagatcacgcccggcatgctcatggcggccgtgcgctgcaacgtgccggcggtcttcgtctccggcggcccgatggaggccgggaggtcgcgcacgggtcgtccgctttccctcagctcggtcttcgaaggcgtgggccagtacatgagcgggcaaatctccgaagatgacctgctggatctggagcggaacgcgtgtcccacgtgtggctcgtgttctggcatgttcaccgccaactccatgaactgcatcatggagatgctggggattgcgctccccggcaatggcacgctggtcgccacgtccaaggagcggcacgagctgatttatgaggccgccaaacacctcattcgcatggtggagcaggacattcggccgcgcgacatcatcacccgcgaagccattgatgacgcgttcgcgctggatatggccatgggcggatcgaccaacacggttctgcacctgatggccatcgcgcatgaggcgggcatcgactattccctgagcgatatcaacgaaattgccaaaagagtgccgtatctcgcgaagattagtcccgcgtccgagtacagcatccaggacgtgcaccgcgcgggcggcgtgtccgccatcatccgcgagctgtgcgaacacaccgacgcggttcacccggatcgcatcacggtgacgggcaagacgctgtacgagcaggtcaaggacgcgaagatcctcgacgaacgcgtcatccgcccggcttccaacccgtacagccgcgagggcggtctgtccatcctgtttggcaatctcgcgccggacggcgcggtgctgaaagtcggtgcggtcgatcccgacatccagcgattcgtgggccgcgccatctgcttcaattcgcaggacgaggcgatggagggcatcaacagcggcaaggtgcaaccgggtcacgtcgtggtcattcgctatgaagggccgaagggcgggccggggatgcccgagatgctggcgcccacgtcgtccatcgtgggccggggcctcggccgcgaggtggcccttatcacggacggccggttttcgggggccacgcgagggatttgcgtcggccatatctcgcccgaggccggcgtaggtgggccgattgcgctcgtcgaggatggggacgagatcgagatcgacattccgaatcgcgccatcaccctgaaggtgtcggacgaggaactggcagcgcgcagggcgcgatatcagccgcccgcgaaagaaaagctcacgggctacctcgctcgatatcagaagttggtcacgtcggcgaacaccggtgctgttctgacggtggacgcatga

SEQ ID NO: 156 - protein, 555 aa, Bacillus halodurans C-125
MRSDMIKKGIDRAPHRSLLRAAGVKEEEMDKPFIGVCNSYIDIIPGHMHLNKFAEVAKEAIREAGGIPFEFNTIGVDDGIAMGHIGMRYSLPSREIICDAAETVINAHWFDGVFFIPNCDKITPGMLMASVRTNVPSVFVSGGPMEAGRTKDGKNLSLASVFEGVGAFSSGKMTREELLEIEQTACPTCGSCSGMFTANSMNSLMEMLGMALPGNGTIVATSEARHQLIKDAAKHLMNLIEKDIRPRDIITKETIDDAFALDMAMGGSTNTVLHTLAIANEAEIEYDLNRINEVAERVPYLCKISPASDYSMDDVHHAGGVAAIIKELCEIDGAIHPDRITITGKSIYENVKDAEITDDVVIRRKDNPYSPVGGLSILFGNLAPNGAVIKVGAVDPSIQIFEGEAIVYNSQEEAQQGINNGDVREGHVVVIRYEGPKGGPGMPEMLAPTSAIIGRGLGTKVALITDGRFSGASRGISIGHISPEAAEGGPIAFIENGDKIRIDLPNRTIEWLVSDEEIAKRQEGWTEPEPKVKKGYLARYSKLVTSANTGGVMKI

SEQ ID NO: 157 - protein, 555 aa, Bacillus coagulans 36D1
MRSDMIKKGIDRAPHRSLLYAAGLKTEDFDKPFIGVCNSYIDIIPGHRHLNKFAEVVKEAIREAGGVPFEFNTIGVDDGIAMGHIGMRYSLPSRELIADSAETVINAHWFDGVFYIPNCDKITPGMLMAAVRTNVPAVFVSGGPMEAGMAPDGKQLSLTSVFEGVGAHKSGKISYEELKMLETSACPTCGSCSGMFTANSMNSLMEMLGLTPPGNATIVATSEERHRIIREAVGHLMNCIKNDIRPRDIVTEEAIDDAFALDMAMGGSTNTVLHTLAIAREAGIDYDLERINKVAERVPYLAKIMPASDYSMHDVHLAGGISAIVHELCKIEGAIHPGRLTITGKSIYENVKDAEIRNPEVIRPKENPYSPVGGLSILYGNIAPDGAVIKVGAVDPDIHTFTGEAIVFESQEEAQKGIDSGLVHEGHVVVIRYEGPKGGPGMPEMLAPTSSIMGRGLGKTVALITDGRFSGATRGICVGHISPEAAEGGPIALVENGDRITIDLINRRIELHVPDEELQRRKQNWVQPEPKITSGYLARYSALVTSANTGGVLKI

SEQ ID NO: 158 - protein, 556 aa, Bacillus sp. B14905
MRSDMIKVGVDRAPHRSLLYATGKVKAKDLGKPFIGVCNSYIDIIPGHVHLRTFADVVKEAIIEAGGIPFEFNTIGVDDGIAMGHIGMRYSLPSREIIADSAETVINAHWFDGVFYIPNCDKITPGMLMAAVRTNVPSIFVSGGPMEAGTSASGKQLSLTSVFEGVGAHKSGNMSAEELLDIENNACPTCGSCSGMFTANSMNCLMEMLGVALPGNGTIVATSEERHKLIKEAAKQLIRMVKEDIKPRDIITKEAIDDAFALDMAMGGSTNTVLHTLAIANEAEIDYNIEDINKVAERVPYLAKIMPASDISMDDINKAGGVSAIINELVSIPGAIHPNRPTVAGVTMGELVKDHHITNNQVIRTKENPYSAVGGLSVLFGNIAPEGSVIKVGAVDPSIQVFKGQAIVFDSQEAAQENIDNGIVKEGHVVVIRYEGPKGGPGMPEMLAPTSAIQGRGLGTKVALITDGRFSGASRGISIGHISPEAAEGGPIALVEDGDMIEIDLPNRTINLQVSEEVLAERRAKLPVFEPKIKRGWLARYSKLVTNASTGGVMKI

SEQ ID NO: 159 - protein, 554 aa, Bacillus clausii KSM-K16
MRSNMIKKGIDRAPHRSLLRAAGVKEEDMDKPFIGVCNSYIDIIPGHMHLNKFAEVAKEAIIEAGGIPFEFNTIGVDDGIAMGHIGMRYSLPSREIICDAAETVINAHWFDGVFYIPNCDKITPGMLMAAVRTNVPAVFVSGGPMEAGRTKEGKSLSLVSVFEGVGAFSSGKMTREELLEIEQLACPTCGSCSGMFTANSMNSLMEMLGLALPGNGTLVATSTERHNLIKDAAKHLINLIEKDIRPRDIVTEETIDDAFALDMAMGGSTNTVLHTLAIANEAEIDYDLTRINEVAERVPYLCKISPASDYSMDDVHKAGGVAAIMKELIEMGAVKGDRITITGKSLYENVAHAQITNTDVIRTKETAYSPVGGLSILYGNLAPDGAVIKVGAVDPSIKTFTGEAIVFNSQEEAQEQINNGAVKEGQVVVIRYEGPKGGPGMPEMLAPTSAIQGRGLGTKVALITDGRFSGASRGISIGHISPEAAEGGPIAFVENGDMIKIDLIERTIEWEISEEELAKRREGWTEPEPKVKKGYLARYSKLVTSANTGGVMKI

SEQ ID NO: 160 - protein, 558 aa, Listeria welshimeri serovar 6b str. SLCC5334
MRSDKIKKGVEQAPARSLLHATGQIKSPGDMDKPFIAICNSYIDIVPGHVHLRELADVAKEAIREAGGIPFEFNTIGVDDGIAMGHIGMRYSLPSREVIADAAETVINAHWFDGVFYIPNCDKITPGMLLASVRTNVPAIFCSGGPMKAGLSAHGKALTLSSVFEAVGAFKDGSMSQEDFLDMEANACPTCGSCAGMFTANSMNCLMEILGMAVPGNGTTLAVSDARRELIRESAFHLMDLVKKDIRPRDIITKDAIDDAFALDMAMGGSTNTVLHTLALANEAGIEDYDLERINDIAKRVPYLSKIAPSSSYSMHDVHEAGGVSAIVKELVDLGGAIHPDRITVTGKTIRENVADAKINNTDVIHPKENPYSPVGGLSMLFGNIAPKGAAIKVGGVDPSVQVFKGEAICFSSHDEAVEAIDNHTVREGHVVVIRYEGPKGGPGMPEMLAPTSSIVGRGLGKDVALITDGRFSGATRGIAVGHISPEAAAGGPIALVHDGDIITIDLPNRTLNVDVSDEVLEERRKELPKFKAKVKTGYLARYTALVTSAHTGGILQI

SEQ ID NO: 161 - protein, 557 aa, Artificial
  Substituion in SEQ ID NO 154
MRSDMIKKGVDRAPHRALLYATGVKPRDLSKPFIGVCNSYVDIVPGHVHLREFAEVVKDAIRQAGGVPFEFNTIGVDDGIAMGHIGMRYSLASRELIADSAETMINAHWFDGVFFIPNCDKITPGMLMAAVRCNVPAVFVSGGPMEAGRSRTGRPLSLSSVFEGVGQYMSGQISEDDLLDLERNACPTCGSCSGMFTANSMNCIMEMLGIALPGNGTLVATSKERHELIYEAAKHLIRMVEQDIRPRDIITREAIDDAFALDMAMGGSTNTVLHLMAIAHEAGIDYSLSDINEIAKRVPYLAKISPASEYSIQDVHRAGGVSAIIRELCEHTDAVHPDRITVTGKTLYEQVKDAKILDERVIRPASNPYSREGGLSILFGNLAPDGAVLKVGAVDPDIQRFVGRAICFNSQDEAMEGINSGKVQPGHVVVIRYEGPKGGPGMPEMLAPTSSIVGRGLGREVALITDGRFSGATRGICVGHISPEAGVGGPIALVEDGDDIEIDIPNRAITLKVSDEELAARRARYQPPAKEKLTGYLARYQKLVTSANTGAVLTVDA

SEQ ID NO: 162 - protein, 557 aa, Artificial
  Substituion in SEQ ID NO 154
MRSDMIKKGVDRAPHRALLYATGVKPRDLSKPFIGVCNSYVDIVPGHVHLREFAEVVKDAIRQAGGVPFEFNTIGVDDGIAMGHIGMRYSLASRELIADSAETMINAHWFDGVFFIPNCDKITPGMLMAAVRCNVPAVFVSGGPMEAGRSRTGRPLSLSSVFEGVGQYMSGQISEDDLLDLERNACPTCGSCSGMFTANSMNCIMEMLGIALPGNGTLVATSKERHELIYEAAKHLIRMVEQDIRPRDIITREAIDDAFALDMAMGGSTNTVLHLMAIAHEAGIDYSLSDINEIAKRVPYLAKISPASEYSIQDVHRAGGVSAIIRELCEHTDAVHPDRITVTGKTLYEQVKDAKILDERVIRPASNPYSREGGLSILFGNLAPDGAVLKVGAVDPDIQRFVGRAICFNSQDEAMEGINSGKVQPGHVVVIRYEGPKGGPGMPEMLAPTSSIVGRGLGREVALITDGRFSGATRGICVGHISPEAGVGGPIALVEDGDEIDIDIPNRAITLKVSDEELAARRARYQPPAKEKLTGYLARYQKLVTSANTGAVLTVDA

SEQ ID NO: 163 - protein, 557 aa, Artificial
  Substituion in SEQ ID NO 154
MRSDMIKKGVDRAPHRALLYATGVKPRDLSKPFIGVCNSYVDIVPGHVHLREFAEVVKDAIRQAGGVPFEFNTIGVDDGIAMGHIGMRYSLASRELIADSAETMINAHWFDGVFFIPNCDKITPGMLMAAVRCNVPAVFVSGGPMEAGRSRTGRPLSLSSVFEGVGQYMSGQISEDDLLDLERNACPTCGSCSGMFTANSMNCIMEMLGIALPGNGTLVATSKERHELIYEAAKHLIRMVEQDIRPRDIITREAIDDAFALDMAMGGSTNTVLHLMAIAHEAGIDYSLSDINEIAKRVPYLAKISPASEYSIQDVHRAGGVSAIIRELCEHTDAVHPDRITVTGKTLYEQVKDAKILDERVIRPASNPYSREGGLSILFGNLAPDGAVLKVGAVDPDIQRFVGRAICFNSQDEAMEGINSGKVQPGHVVVIRYEGPKGGPGMPEMLAPTSSIVGRGLGKEVALITDGRFSGATRGICVGHISPEAGVGGPIALVEDGDEIEIDIPNRAITLKVSDEELAARRARYQPPAKEKLTGYLARYQKLVTSANTGAVLTVDA

SEQ ID NO: 164 - protein, 557 aa, Artificial
  Substituion in SEQ ID NO 154
MRSDMIKKGVDRAPHRALLYATGVKPRDLSKPFIGVCNSYVDIVPGHVHLREFAEVVKDAIRQAGGVPFEFNTIGVDDGIAMGHIGMRYSLASRELIADSAETMINAHWFDGVFFIPNCDKITPGMLMAAVRCNVPAVFVSGGPMEAGRSRTGRPLSLSSVFEGVGQYMSGQISEDDLLDLERNACPTCGSCSGMFTANSMNCIMEMLGIALPGNGTLVATSKERHELIYEAAKHLIRMVEQDIRPRDIITREAIDDAFALDMAMGGSTNTVLHLMAIAHEAGIDYSLSDINEIAKRVPYLAKISPASEYSIQDVHRAGGVSAIIRELCEHTDAVHPDRITVTGKTLYEQVKDAKILDERVIRPASNPYSREGGLSILFGNLAPDGAVLKVGAVDPDIQRFVGRAICFNSQDEAMEGINSGKVQPGHVVVIRYEGPKGGPGMPEMLAPTSSIVGRGLGREVALITDGRFSGATRGICVGHISPEAGVGGPIALVEDGDEIEIDIPNRAITLKVSDEELAARRARYQPPAKEKLTGYLARYQKLVTSANTGAVLTVEA

SEQ ID NO: 165 - protein, 557 aa, Artificial
  Substituion in SEQ ID NO 154
MRSDMIKKGVDRAPHRALLYATGVKPRDLSKPFIGVCNSYVDIVPGHVHLREFAEVVKDAIRQAGGVPFEFNTIGVDDGIAMGHIGMRYSLASRELIADSAETMINAHWFDGVFFIPNCDKITPGMLMAAVRCNVPAVFVSGGPMEAGRSRTGRPLSLSSVFEGVGQYMSGQISEDDLLDLERNACPTCGSCSGMFTANSMNCIMEMLGIALPGNGTLVATSKERHELIYEAAKHLIRMVEQDIRPRDIITREAIDDAFALDMAMGGSTNTVLHLMAIAHEAGIDYSLSDINEIAKRVPYLAKISPASEYSIQDVHRAGGVSAIIRELCEHTDAVHPDRITVTGKTLYEQVKDAKILDERVIRPASNPYSREGGLSILFGNLAPDGAVLKVGAVDPDIQRFVGRAICFNSQDEAMEGINSGKVQPGHVVVIRYEGPKGGPGMPEMLAPTSSIVGRGLGREVALITDGRFSGATRGICVGHISPEAGVGGPIALVEDGDEIEIDIPNRAITLKVSDEELAARRARYQPPAKERLTGYLARYQKLVTSANTGAVLTVDA

SEQ ID NO: 166 - DNA, 1674 bp, Artificial
  Substituion in SEQ ID NO 155
atgagaagcgacatgatcaaaaagggcgtggaccgggcgccgcacagggccctgctctatgccacgggcgtcaaacccagggatctgtccaaaccgtttatcggcgtgtgcaactcgtacgtcgacatcgttccgggccacgttcatctccgcgaattcgcggaagtcgtgaaagatgccatccgccaggcaggtggcgtcccgttcgaattcaacaccatcggtgtggacgacgggatcgccatggggcacatcggcatgcggtattcgctcgcgagccgcgagctcatcgccgattcggccgagacgatgatcaacgcccactggttcgacggcgtctttttcatccccaactgtgacaagatcacgcccggcatgctcatggcggccgtgcgctgcaacgtgccggcggtcttcgtctccggcggcccgatggaggccgggaggtcgcgcacgggtcgtccgctttccctcagctcggtcttcgaaggcgtgggccagtacatgagcgggcaaatctccgaagatgacctgctggatctggagcggaacgcgtgtcccacgtgtggctcgtgttctggcatgttcaccgccaactccatgaactgcatcatggagatgctggggattgcgctccccggcaatggcacgctggtcgccacgtccaaggagcggcacgagctgatttatgaggccgccaaacacctcattcgcatggtggagcaggacattcggccgcgcgacatcatcacccgcgaagccattgatgacgcgttcgcgctggatatggccatgggcggatcgaccaacacggttctgcacctgatggccatcgcgcatgaggcgggcatcgactattccctgagcgatatcaacgaaattgccaaaagagtgccgtatctcgcgaagattagtcccgcgtccgagtacagcatccaggacgtgcaccgcgcgggcggcgtgtccgccatcatccgcgagctgtgcgaacacaccgacgcggttcacccggatcgcatcacggtgacgggcaagacgctgtacgagcaggtcaaggacgcgaagatcctcgacgaacgcgtcatccgcccggcttccaacccgtacagccgcgagggcggtctgtccatcctgtttggcaatctcgcgccggacggcgcggtgctgaaagtcggtgcggtcgatcccgacatccagcgattcgtgggccgcgccatctgcttcaattcgcaggacgaggcgatggagggcatcaacagcggcaaggtgcaaccgggtcacgtcgtggtcattcgctatgaagggccgaagggcgggccggggatgcccgagatgctggcgcccacgtcgtccatcgtgggccggggcctcggccgcgaggtggcccttatcacggacggccggttttcgggggccacgcgagggatttgcgtcggccatatctcgcccgaggccggcgtaggtgggccgattgcgctcgtcgaggatggggacgatatcgagatcgacattccgaatcgcgccatcaccctgaaggtgtcggacgaggaactggcagcgcgcagggcgcgatatcagccgcccgcgaaagaaaagctcacgggctacctcgctcgatatcagaagttggtcacgtcggcgaacaccggtgctgttctgacggtggacgcatga

SEQ ID NO: 167 - DNA, 1674 bp, Artificial
  Substituion in SEQ ID NO 155
atgagaagcgacatgatcaaaaagggcgtggaccgggcgccgcacagggccctgctctatgccacgggcgtcaaacccagggatctgtccaaaccgtttatcggcgtgtgcaactcgtacgtcgacatcgttccgggccacgttcatctccgcgaattcgcggaagtcgtgaaagatgccatccgccaggcaggtggcgtcccgttcgaattcaacaccatcggtgtggacgacgggatcgccatggggcacatcggcatgcggtattcgctcgcgagccgcgagctcatcgccgattcggccgagacgatgatcaacgcccactggttcgacggcgtctttttcatccccaactgtgacaagatcacgcccggcatgctcatggcggccgtgcgctgcaacgtgccggcggtcttcgtctccggcggcccgatggaggccgggaggtcgcgcacgggtcgtccgctttccctcagctcggtcttcgaaggcgtgggccagtacatgagcgggcaaatctccgaagatgacctgctggatctggagcggaacgcgtgtcccacgtgtggctcgtgttctggcatgttcaccgccaactccatgaactgcatcatggagatgctggggattgcgctccccggcaatggcacgctggtcgccacgtccaaggagcggcacgagctgatttatgaggccgccaaacacctcattcgcatggtggagcaggacattcggccgcgcgacatcatcacccgcgaagccattgatgacgcgttcgcgctggatatggccatgggcggatcgaccaacacggttctgcacctgatggccatcgcgcatgaggcgggcatcgactattccctgagcgatatcaacgaaattgccaaaagagtgccgtatctcgcgaagattagtcccgcgtccgagtacagcatccaggacgtgcaccgcgcgggcggcgtgtccgccatcatccgcgagctgtgcgaacacaccgacgcggttcacccggatcgcatcacggtgacgggcaagacgctgtacgagcaggtcaaggacgcgaagatcctcgacgaacgcgtcatccgcccggcttccaacccgtacagccgcgagggcggtctgtccatcctgtttggcaatctcgcgccggacggcgcggtgctgaaagtcggtgcggtcgatcccgacatccagcgattcgtgggccgcgccatctgcttcaattcgcaggacgaggcgatggagggcatcaacagcggcaaggtgcaaccgggtcacgtcgtggtcattcgctatgaagggccgaagggcgggccggggatgcccgagatgctggcgcccacgtcgtccatcgtgggccggggcctcggccgcgaggtggcccttatcacggacggccggttttcgggggccacgcgagggatttgcgtcggccatatctcgcccgaggccggcgtaggtgggccgattgcgctcgtcgaggatggggacgagatcgatatcgacattccgaatcgcgccatcaccctgaaggtgtcggacgaggaactggcagcgcgcagggcgcgatatcagccgcccgcgaaagaaaagctcacgggctacctcgctcgatatcagaagttggtcacgtcggcgaacaccggtgctgttctgacggtggacgcatga

SEQ ID NO: 168 - DNA, 1674 bp, Artificial
  Substituion in SEQ ID NO 155
atgagaagcgacatgatcaaaaagggcgtggaccgggcgccgcacagggccctgctctatgccacgggcgtcaaacccagggatctgtccaaaccgtttatcggcgtgtgcaactcgtacgtcgacatcgttccgggccacgttcatctccgcgaattcgcggaagtcgtgaaagatgccatccgccaggcaggtggcgtcccgttcgaattcaacaccatcggtgtggacgacgggatcgccatggggcacatcggcatgcggtattcgctcgcgagccgcgagctcatcgccgattcggccgagacgatgatcaacgcccactggttcgacggcgtctttttcatccccaactgtgacaagatcacgcccggcatgctcatggcggccgtgcgctgcaacgtgccggcggtcttcgtctccggcggcccgatggaggccgggaggtcgcgcacgggtcgtccgctttccctcagctcggtcttcgaaggcgtgggccagtacatgagcgggcaaatctccgaagatgacctgctggatctggagcggaacgcgtgtcccacgtgtggctcgtgttctggcatgttcaccgccaactccatgaactgcatcatggagatgctggggattgcgctccccggcaatggcacgctggtcgccacgtccaaggagcggcacgagctgatttatgaggccgccaaacacctcattcgcatggtggagcaggacattcggccgcgcgacatcatcacccgcgaagccattgatgacgcgttcgcgctggatatggccatgggcggatcgaccaacacggttctgcacctgatggccatcgcgcatgaggcgggcatcgactattccctgagcgatatcaacgaaattgccaaaagagtgccgtatctcgcgaagattagtcccgcgtccgagtacagcatccaggacgtgcaccgcgcgggcggcgtgtccgccatcatccgcgagctgtgcgaacacaccgacgcggttcacccggatcgcatcacggtgacgggcaagacgctgtacgagcaggtcaaggacgcgaagatcctcgacgaacgcgtcatccgcccggcttccaacccgtacagccgcgagggcggtctgtccatcctgtttggcaatctcgcgccggacggcgcggtgctgaaagtcggtgcggtcgatcccgacatccagcgattcgtgggccgcgccatctgcttcaattcgcaggacgaggcgatggagggcatcaacagcggcaaggtgcaaccgggtcacgtcgtggtcattcgctatgaagggccgaagggcgggccggggatgcccgagatgctggcgcccacgtcgtccatcgtgggccggggcctcggcaaagaggtggcccttatcacggacggccggttttcgggggccacgcgagggatttgcgtcggccatatctcgcccgaggccggcgtaggtgggccgattgcgctcgtcgaggatggggacgagatcgagatcgacattccgaatcgcgccatcaccctgaaggtgtcggacgaggaactggcagcgcgcagggcgcgatatcagccgcccgcgaaagaaaagctcacgggctacctcgctcgatatcagaagttggtcacgtcggcgaacaccggtgctgttctgacggtggacgcatga

SEQ ID NO: 169 - DNA, 1674 bp, Artificial
  Substituion in SEQ ID NO 155
atgagaagcgacatgatcaaaaagggcgtggaccgggcgccgcacagggccctgctctatgccacgggcgtcaaacccagggatctgtccaaaccgtttatcggcgtgtgcaactcgtacgtcgacatcgttccgggccacgttcatctccgcgaattcgcggaagtcgtgaaagatgccatccgccaggcaggtggcgtcccgttcgaattcaacaccatcggtgtggacgacgggatcgccatggggcacatcggcatgcggtattcgctcgcgagccgcgagctcatcgccgattcggccgagacgatgatcaacgcccactggttcgacggcgtctttttcatccccaactgtgacaagatcacgcccggcatgctcatggcggccgtgcgctgcaacgtgccggcggtcttcgtctccggcggcccgatggaggccgggaggtcgcgcacgggtcgtccgctttccctcagctcggtcttcgaaggcgtgggccagtacatgagcgggcaaatctccgaagatgacctgctggatctggagcggaacgcgtgtcccacgtgtggctcgtgttctggcatgttcaccgccaactccatgaactgcatcatggagatgctggggattgcgctccccggcaatggcacgctggtcgccacgtccaaggagcggcacgagctgatttatgaggccgccaaacacctcattcgcatggtggagcaggacattcggccgcgcgacatcatcacccgcgaagccattgatgacgcgttcgcgctggatatggccatgggcggatcgaccaacacggttctgcacctgatggccatcgcgcatgaggcgggcatcgactattccctgagcgatatcaacgaaattgccaaaagagtgccgtatctcgcgaagattagtcccgcgtccgagtacagcatccaggacgtgcaccgcgcgggcggcgtgtccgccatcatccgcgagctgtgcgaacacaccgacgcggttcacccggatcgcatcacggtgacgggcaagacgctgtacgagcaggtcaaggacgcgaagatcctcgacgaacgcgtcatccgcccggcttccaacccgtacagccgcgagggcggtctgtccatcctgtttggcaatctcgcgccggacggcgcggtgctgaaagtcggtgcggtcgatcccgacatccagcgattcgtgggccgcgccatctgcttcaattcgcaggacgaggcgatggagggcatcaacagcggcaaggtgcaaccgggtcacgtcgtggtcattcgctatgaagggccgaagggcgggccggggatgcccgagatgctggcgcccacgtcgtccatcgtgggccggggcctcggccgcgaggtggcccttatcacggacggccggttttcgggggccacgcgagggatttgcgtcggccatatctcgcccgaggccggcgtaggtgggccgattgcgctcgtcgaggatggggacgagatcgagatcgacattccgaatcgcgccatcaccctgaaggtgtcggacgaggaactggcagcgcgcagggcgcgatatcagccgcccgcgaaagaaaagctcacgggctacctcgctcgatatcagaagttggtcacgtcggcgaacaccggtgctgttctgacggtggaagcatga

SEQ ID NO: 170 - DNA, 1674 bp, Artificial
  Substituion in SEQ ID NO 155
atgagaagcgacatgatcaaaaagggcgtggaccgggcgccgcacagggccctgctctatgccacgggcgtcaaacccagggatctgtccaaaccgtttatcggcgtgtgcaactcgtacgtcgacatcgttccgggccacgttcatctccgcgaattcgcggaagtcgtgaaagatgccatccgccaggcaggtggcgtcccgttcgaattcaacaccatcggtgtggacgacgggatcgccatggggcacatcggcatgcggtattcgctcgcgagccgcgagctcatcgccgattcggccgagacgatgatcaacgcccactggttcgacggcgtctttttcatccccaactgtgacaagatcacgcccggcatgctcatggcggccgtgcgctgcaacgtgccggcggtcttcgtctccggcggcccgatggaggccgggaggtcgcgcacgggtcgtccgctttccctcagctcggtcttcgaaggcgtgggccagtacatgagcgggcaaatctccgaagatgacctgctggatctggagcggaacgcgtgtcccacgtgtggctcgtgttctggcatgttcaccgccaactccatgaactgcatcatggagatgctggggattgcgctccccggcaatggcacgctggtcgccacgtccaaggagcggcacgagctgatttatgaggccgccaaacacctcattcgcatggtggagcaggacattcggccgcgcgacatcatcacccgcgaagccattgatgacgcgttcgcgctggatatggccatgggcggatcgaccaacacggttctgcacctgatggccatcgcgcatgaggcgggcatcgactattccctgagcgatatcaacgaaattgccaaaagagtgccgtatctcgcgaagattagtcccgcgtccgagtacagcatccaggacgtgcaccgcgcgggcggcgtgtccgccatcatccgcgagctgtgcgaacacaccgacgcggttcacccggatcgcatcacggtgacgggcaagacgctgtacgagcaggtcaaggacgcgaagatcctcgacgaacgcgtcatccgcccggcttccaacccgtacagccgcgagggcggtctgtccatcctgtttggcaatctcgcgccggacggcgcggtgctgaaagtcggtgcggtcgatcccgacatccagcgattcgtgggccgcgccatctgcttcaattcgcaggacgaggcgatggagggcatcaacagcggcaaggtgcaaccgggtcacgtcgtggtcattcgctatgaagggccgaagggcgggccggggatgcccgagatgctggcgcccacgtcgtccatcgtgggccggggcctcggccgcgaggtggcccttatcacggacggccggttttcgggggccacgcgagggatttgcgtcggccatatctcgcccgaggccggcgtaggtgggccgattgcgctcgtcgaggatggggacgagatcgagatcgacattccgaatcgcgccatcaccctgaaggtgtcggacgaggaactggcagcgcgcagggcgcgatatcagccgcccgcgaaagaacgtctcacgggctacctcgctcgatatcagaagttggtcacgtcggcgaacaccggtgctgttctgacggtggacgcatga

SEQ ID NO: 171 - protein, 586 aa, Alicyclobacillus acidocaldarius
MWRGGNAMPGMSKPADDETLTRSGEGGAMWMKGADMVVEALRREQVEVIFGYPGGAVLPLYDALYQCGIRHVLTRHEQGAIHAAEGYARVTGKPGVVIATSGPGATNLVTGLADAMMDSIPLVAITGQVAKTVIGTDAFQETSIIGISTPITKHNYQIRHASEIPKVFKEAFHIANSGRKGPVLIDIPKDVSGEEAWFAYDDPPQLPGYQPTVVPHHMQIRKLMHGLQHAKRPVVLAGAGVLHARATEKLLAFVEKYQLPVVQTLLGLGSFPASHPLCLGMGGMHGSAAANKALYETDFLINLGARFDDRLTGKLEHFAPHAVVAHIDIDPAEIGKNVPTDIPVVGDVGEALSMMLSIDVPAPDAEAWREELLRVKRELPFWWVQDGKHIKPQRLISEIARITKGDVVVTTDVGQHQMWAAQFFPLNQPDRWVTSGGLGTMGFGLPAAIGAHFGQPDKLVVAILGDAGFQMTLQELAVIGEHQLPIKVVIVNNSALGMVRQWQELFHGERYSESLLPWQPDFVKLGEAYRIPSARVERDEDLTAALEAFLSEPGPGLLECVVDPNENVYPMVAPGTGIHQMVGVRP

SEQ ID NO: 172 - DNA, 1761 bp, Alicyclobacillus acidocaldarius
ttgtggagaggaggaaacgcgatgcctggaatgtcaaaaccggcagatgacgagacgctgacgcgctcgggagaaggcggagccatgtggatgaaaggtgccgacatggtcgtagaggcgctgcgccgcgagcaggtcgaggtcatcttcgggtatcccggtggagcggtgctaccgctgtacgacgcgctctaccaatgtggcattcgccatgtgttgacacgccatgagcaaggcgccattcacgctgcggagggctacgctcgcgtaacgggaaagccgggcgtcgtgatcgccacaagtgggccaggtgccacgaacctcgtcaccgggttggccgacgcgatgatggacagcattccgctcgtcgccatcacgggacaggtggcgaagacggtgattggcaccgatgcgtttcaggagacgtccatcattggcatctcgacgcccatcacaaagcataactatcagattcggcacgcgtcggagattccgaaggtcttcaaagaggcgttccacatcgccaactcgggccgtaaagggcctgtgctgatcgatattcccaaggacgtctcaggggaagaggcgtggttcgcgtatgacgatccgccgcagctgccggggtatcagccgactgtggtgcctcaccacatgcagattcggaagttgatgcacggcttgcaacacgccaagcggcccgtggtgctggcaggagccggcgtcctgcacgcgagggcgaccgagaagctcctggcgttcgtcgaaaagtatcagcttccggtggtgcagaccttgctcggccttggcagctttccggcgtctcacccgctctgcctcggcatgggcggtatgcacggaagcgcggcggccaacaaggcgctgtacgagacggacttcctcatcaatctcggcgcccggtttgacgatcggctgaccggcaagttggagcacttcgcgccgcacgccgtcgtggcgcacatcgacatcgatccggccgagatcggcaaaaacgtcccgaccgacattccggtggtgggcgacgtcggcgaggcgctctccatgatgctcagcatcgacgtcccggcgccggacgcggaggcgtggcgcgaggaactgctgcgggtgaaaagggaacttccgttttggtgggtccaggatgggaagcacatcaagccgcagcggctcatctcggaaattgcgcggatcacaaagggggacgtcgtggtcacaacggacgtcggccaacaccaaatgtgggctgcgcaattcttcccgctgaatcagccggatcggtgggtgacctccggtggactgggcaccatgggttttggcttaccagcggccatcggtgcgcacttcggacagccggataagctcgtggtggcgatcctgggcgacgcggggttccagatgacgctgcaggaactcgccgtgattggcgagcaccagttgcccatcaaggtcgtgatcgtcaacaacagcgcgctgggcatggtgaggcagtggcaggagctgtttcacggcgagcggtactcggaatcgctgcttccgtggcagcctgacttcgtgaagctgggcgaggcgtaccgcattccctcggcgcgcgtggagcgggacgaggatctgaccgcagcgctcgaggcgtttctcagtgaaccgggtccaggtctcctggagtgcgtggtggatccgaacgagaacgtgtaccccatggtcgcgccgggcaccgggatccaccagatggtgggggtgaggccatga

SEQ ID NO: 173 - protein, 555 aa, Geobacillus thermodenitrificans NG80-2
MSGSLMLIEALKAENVEVIFGYPGGAVLPLYDELYKAGVFHVLTRHEQGAIHAAEGYARISGKPGVVIATSGPGATNIVTGLTDAMMDSLPLVVFTGQVATNVIGSDAFQEADVVGITMPITKHNYQVRDISELPKIIKEAFHIATTGRPGPVLIDIPKDVTIAEGEFDYNQDVHLPGYQPTTQPNHWQIRRLVEAVSQSKRPVILAGAGVLHANAADELQQYAEQQNIPVAHTLLGLGGFPADHPLFLGMAGMHGTYAANMALYECDLLINIGARFDDRVTGNLKYFAPKATVAHIDIDPAEIGKNVPTKIPIVSDAKAALQELIEQQGKPADNAAWLAQLNEWKRRFPLHYEPEAGAIKPQKLIEMIYEVTGGEAIVTTDVGQHQMWAAQYYKFNRPNRWVTSGGLGTMGFGLPAAIGAQLADQSATVVSIVGDGGFQMTCQELSVIQELQLPIKVVIVNNQALGMVRQWQELFYDKRYSHSLIPNQPDFVKLAEAYGMPGLRAKTEAEAAEVLKQAFAIDGPVLLDFHVCADENVYPMVAPGKGLHEMVGVK

SEQ ID NO: 174 - protein, 557 aa, Bacillus pumilus SAFR-032
MNGALMLIEALKREKVEVIFGYPGGAVLPIYDKIYDSGLFHVLPRHEQGAIHAAEGYARVSGKPGVVIATSGPGATNLVTGIADAMIDSLPLVVFTGQVATSVIGSDAFQEADVLGITMPITKHSYQVRNPEELPGVIKEAFHIATTGRPGPVLIDIPKDVAGIEGTFEYDQPIDLPGYQPKVEPNYLQIRKLVEAVSRAKKPVILAGAGVLHGKASEELRQYVEQQQIPVAHTLLGLGGFPAKHPLFLGMAGMHGTYAANMALHQCDLLISIGARFDDRVTGNLNHFAKHAKVAHIDIDPAEIGKNIHTHIPVVGDSKLVLQELIKQDGKQGESDEWKNQLDQWKEEYPLWYVENEAEGFKPQKLIEYIHQFTKGEAIVATDVGQHQMWAAQFYPFENADKWVTSGGLGTMGFGLPAAIGAQLADQEATVVAILGDGGFQMTLQELAVIRELNLPVKVIVLNNHSLGMVRQWQEIFYEERYSYSKFSEQPDFVKLSEAYGIKGIRISSDEEAKEKLEEALTSREPVFIDVNVARDEKVFPMVAPGKGLHEMVGVKP

SEQ ID NO: 175 - protein, 577 aa, Geobacillus kaustophilus HTA426
QGGSTMTKMKVEEQEKARTKARMSGSLMLIEALKEEKVEVIFGYPGGAVLPLYDELYKAGVFHVLTRHEQGAIHAAEGYARISGKPGVVIATSGPGATNIVTGLTDAMMDSLPLVVFTGQVATSVIGSDAFQEADVVGITMPITKHNYQVRDISELPRIIKEAFHIATTGRPGPVLIDIPKDITTAEGEFDYDQDVHLPGYQPTTQPNHWQIRRLVEAVSQSKRPVILAGAGILHANASNELRQYAEQQNIPVIHTLLGLGGFPADHPLFLGMAGMHGTYTANMALCECDLLINIGARFDDRVTGNLKYFAPKATVAHIDIDPAEIGKNVPTKIPIVSDAKAALQELIAQQGKPADTAAWLTQLDEWKRRFPLHYEPEAGTIKPQKLIEMIYEMTNGEAIVTTDVGQHQMWAAQYYKFNRPHRWVTSGGLGTMGFGLPAAIGAQLADRSATVVSIVGDGGFQMTFQELSVIQELRLPIKIVIVNNQALGMVRQWQELFYDKRYSHSLIPNQPDFVKLAEAYGMPGLRAKTEAEAAEVLKQAFAMDGPVLLDFHVRADENVYPMVAPGKGLHEMVGVK

SEQ ID NO: 176 - protein, 555 aa, Geobacillus stearothermophilus
MSGSMMLIEALKAEQVEVIFGYPGGAVLPLYDELYKAGVFHVLTRHEQGAIHAAEGYARISGKPGFVIATSGPGATNIVTGLTDAMMDSLPLVVFTGQVATSVIGSDAFQEADVVGITMPITKHNYQVRDISELPKIIKEAFHIATTGRPGPVLIDIPKDITTAEGEFDYDEEVCLPGYQPTTQPNHWQIRRLVEAVSQSKRPVILAGAGVLHADAANELRQYAEQQNIPVVHTLLGLGGFPADHPLFLGMAGMHGTYTANMALYECDLLINIGARFADRVTGNLKYFAPKATVAHIDIDPAEIGKNVPTKIPIVSDAKAALQELIAQQGKPADNAAWLEQLNEWKRRFPLHYEPEAGTIKPQKLIEMIYELTNGEAIVTTDVGQHQMWAAQYYKFNRPNRWVTSGGLGTMGFGLPAAIGAQLADRSATVVSIVGDGGFQMTLQELSVIRELGLPIKIVIVNNQALGMVRQWQELFYEKRYSHSLIPNHPDFVKLAEPYGIPGLRAKTEAESAEVLKQAFAMDGPVLLDFHVRADENVYPMVSPGKGLHEMVGVK

SEQ ID NO: 177 - protein, 554 aa, Bacillus clausii KSM-K16
GSEILLKALASEGVEVIFGYPGGAILPTYDEIYKLGMNHILARHEQGAIHAAEGYARITQKPGVCIVTSGPGATNVVTGIADAMMDSLPMVVITGQVATKVIGTDAFQEADMLGITMPITKHNFQIRSIEELAQTVKEAFHIAVSGRPGPVLIDLPKDISEKLGIFDYEEPVHLPGYQPTVKPNKQQIRKLLDKFKEAKRPVLLVGAGVLHAQASEELTAFARKFQIPVAQTLLGLGAFPGEEELHLGMAGMHGTYAANMALHKSDFLINIGSRFDDRLTGALEHFAPEACIAHIDIDPAEIGKNVHVEIPVVGDAKEALAMLVKGSGAIDEHDEWRKQVSDWKRDYPLWFHRDGEVIKPQELIQKLYEHTKGEAIVTTDVGQHQMWTAQHFKFNKPNRWITSGGLGTMGFGFPAAIGAQIAEPELPVLAITGDAGFQMTLQEMSILQELDLPVKIVIVNNASLGMVRQWQQRFHGERYSHSLFPIQPNFAKLAEAYNIKAVKVDKLSMLDEAIAETLAHPGPVLLEVCVAKEENVYPMVCPGTGHHCMEGVEP

SEQ ID NO: 178 - protein, 586 aa, Artificial
  Substituion in SEQ ID NO 171
MWRGGNAMPGMSKPADDETLTRSGEGGAMWMKGADMVVEALRREQVEVIFGYPGGAVLPLYDALYQCGIRHVLTRHEQGAIHAAEGYARVTGKPGVVIATSGPGATNLVTGLADAMMDSIPLVAITGQVAKTVIGTDAFQETSIIGISTPITKHNYQIRHASEIPKVFKEAFHIANSGRKGPVLIDIPKDVSGEEAWFAYDDPPQLPGYQPTVVPHHMQIRKLMHGLQHAKRPVVLAGAGVLHARATEKLLAFVEKYQLPVVQTLLGLGSFPASHPLCLGMGGMHGSAAANKALYETDFLINLGARFDDRLTGKLEHFAPHAVVAHIDIDPAEIGKNVPTDIPVVGDVGEALSMMLSIDVPAPDAEAWREELLRVKRDLPFWWVQDGKHIKPQRLISEIARITKGDVVVTTDVGQHQMWAAQFFPLNQPDRWVTSGGLGTMGFGLPAAIGAHFGQPDKLVVAILGDAGFQMTLQELAVIGEHQLPIKVVIVNNSALGMVRQWQELFHGERYSESLLPWQPDFVKLGEAYRIPSARVERDEDLTAALEAFLSEPGPGLLECVVDPNENVYPMVAPGTGIHQMVGVRP

SEQ ID NO: 179 - protein, 586 aa, Artificial
  Substituion in SEQ ID NO 171
MWRGGNAMPGMSKPADDETLTRSGEGGAMWMKGADMVVEALRREQVEVIFGYPGGAVLPLYDALYQCGIRHVLTRHEQGAIHAAEGYARVTGKPGVVIATSGPGATNLVTGLADAMMDSIPLVAITGQVAKTVIGTDAFQETSIIGISTPITKHNYQIRHASEIPKVFKEAFHIANSGRKGPVLIDIPKDVSGEEAWFAYDDPPQLPGYQPTVVPHHMQIRKLMHGLQHAKRPVVLAGAGVLHARATEKLLAFVEKYQLPVVQTLLGLGSFPASHPLCLGMGGMHGSAAANKALYETDFLINLGARFDDRLTGKLEHFAPHAVVAHIDIDPAEIGKNVPTDIPVVGDVGDALSMMLSIDVPAPDAEAWREELLRVKRELPFWWVQDGKHIKPQRLISEIARITKGDVVVTTDVGQHQMWAAQFFPLNQPDRWVTSGGLGTMGFGLPAAIGAHFGQPDKLVVAILGDAGFQMTLQELAVIGEHQLPIKVVIVNNSALGMVRQWQELFHGERYSESLLPWQPDFVKLGEAYRIPSARVERDEDLTAALEAFLSEPGPGLLECVVDPNENVYPMVAPGTGIHQMVGVRP

SEQ ID NO: 180 - protein, 586 aa, Artificial
  Substituion in SEQ ID NO 171
MWRGGNAMPGMSKPADDETLTRSGEGGAMWMRGADMVVEALRREQVEVIFGYPGGAVLPLYDALYQCGIRHVLTRHEQGAIHAAEGYARVTGKPGVVIATSGPGATNLVTGLADAMMDSIPLVAITGQVAKTVIGTDAFQETSIIGISTPITKHNYQIRHASEIPKVFKEAFHIANSGRKGPVLIDIPKDVSGEEAWFAYDDPPQLPGYQPTVVPHHMQIRKLMHGLQHAKRPVVLAGAGVLHARATEKLLAFVEKYQLPVVQTLLGLGSFPASHPLCLGMGGMHGSAAANKALYETDFLINLGARFDDRLTGKLEHFAPHAVVAHIDIDPAEIGKNVPTDIPVVGDVGEALSMMLSIDVPAPDAEAWREELLRVKRELPFWWVQDGKHIKPQRLISEIARITKGDVVVTTDVGQHQMWAAQFFPLNQPDRWVTSGGLGTMGFGLPAAIGAHFGQPDKLVVAILGDAGFQMTLQELAVIGEHQLPIKVVIVNNSALGMVRQWQELFHGERYSESLLPWQPDFVKLGEAYRIPSARVERDEDLTAALEAFLSEPGPGLLECVVDPNENVYPMVAPGTGIHQMVGVRP

SEQ ID NO: 181 - protein, 586 aa, Artificial
  Substituion in SEQ ID NO 171
MWRGGNAMPGMSKPADDETLTRSGEGGAMWMKGADMVVEALRREQVEVIFGYPGGAVLPLYDALYQCGIRHVLTRHEQGAIHAAEGYARVTGKPGVVIATSGPGATNLVTGLADAMMDSIPLVAITGQVAKTVIGTDAFQETSIIGISTPITKHNYQIRHASEIPKVFKEAFHIANSGRKGPVLIDIPKDVSGEEAWFAYDDPPQLPGYQPTVVPHHMQIRKLMHGLQHAKRPVVLAGAGVLHARATEKLLAFVEKYQLPVIQTLLGLGSFPASHPLCLGMGGMHGSAAANKALYETDFLINLGARFDDRLTGKLEHFAPHAVVAHIDIDPAEIGKNVPTDIPVVGDVGEALSMMLSIDVPAPDAEAWREELLRVKRELPFWWVQDGKHIKPQRLISEIARITKGDVVVTTDVGQHQMWAAQFFPLNQPDRWVTSGGLGTMGFGLPAAIGAHFGQPDKLVVAILGDAGFQMTLQELAVIGEHQLPIKVVIVNNSALGMVRQWQELFHGERYSESLLPWQPDFVKLGEAYRIPSARVERDEDLTAALEAFLSEPGPGLLECVVDPNENVYPMVAPGTGIHQMVGVRP

SEQ ID NO: 182 - protein, 586 aa, Artificial
  Substituion in SEQ ID NO 171
MWRGGNAMPGMSKPADDETLTRSGDGGAMWMKGADMVVEALRREQVEVIFGYPGGAVLPLYDALYQCGIRHVLTRHEQGAIHAAEGYARVTGKPGVVIATSGPGATNLVTGLADAMMDSIPLVAITGQVAKTVIGTDAFQETSIIGISTPITKHNYQIRHASEIPKVFKEAFHIANSGRKGPVLIDIPKDVSGEEAWFAYDDPPQLPGYQPTVVPHHMQIRKLMHGLQHAKRPVVLAGAGVLHARATEKLLAFVEKYQLPVVQTLLGLGSFPASHPLCLGMGGMHGSAAANKALYETDFLINLGARFDDRLTGKLEHFAPHAVVAHIDIDPAEIGKNVPTDIPVVGDVGEALSMMLSIDVPAPDAEAWREELLRVKRELPFWWVQDGKHIKPQRLISEIARITKGDVVVTTDVGQHQMWAAQFFPLNQPDRWVTSGGLGTMGFGLPAAIGAHFGQPDKLVVAILGDAGFQMTLQELAVIGEHQLPIKVVIVNNSALGMVRQWQELFHGERYSESLLPWQPDFVKLGEAYRIPSARVERDEDLTAALEAFLSEPGPGLLECVVDPNENVYPMVAPGTGIHQMVGVRP

SEQ ID NO: 183 - DNA, 1761 bp, Artificial
  Substituion in SEQ ID NO 172
ttgtggagaggaggaaacgcgatgcctggaatgtcaaaaccggcagatgacgagacgctgacgcgctcgggagaaggcggagccatgtggatgaaaggtgccgacatggtcgtagaggcgctgcgccgcgagcaggtcgaggtcatcttcgggtatcccggtggagcggtgctaccgctgtacgacgcgctctaccaatgtggcattcgccatgtgttgacacgccatgagcaaggcgccattcacgctgcggagggctacgctcgcgtaacgggaaagccgggcgtcgtgatcgccacaagtgggccaggtgccacgaacctcgtcaccgggttggccgacgcgatgatggacagcattccgctcgtcgccatcacgggacaggtggcgaagacggtgattggcaccgatgcgtttcaggagacgtccatcattggcatctcgacgcccatcacaaagcataactatcagattcggcacgcgtcggagattccgaaggtcttcaaagaggcgttccacatcgccaactcgggccgtaaagggcctgtgctgatcgatattcccaaggacgtctcaggggaagaggcgtggttcgcgtatgacgatccgccgcagctgccggggtatcagccgactgtggtgcctcaccacatgcagattcggaagttgatgcacggcttgcaacacgccaagcggcccgtggtgctggcaggagccggcgtcctgcacgcgagggcgaccgagaagctcctggcgttcgtcgaaaagtatcagcttccggtggtgcagaccttgctcggccttggcagctttccggcgtctcacccgctctgcctcggcatgggcggtatgcacggaagcgcggcggccaacaaggcgctgtacgagacggacttcctcatcaatctcggcgcccggtttgacgatcggctgaccggcaagttggagcacttcgcgccgcacgccgtcgtggcgcacatcgacatcgatccggccgagatcggcaaaaacgtcccgaccgacattccggtggtgggcgacgtcggcgaggcgctctccatgatgctcagcatcgacgtcccggcgccggacgcggaggcgtggcgcgaggaactgctgcgggtgaaaagggatcttccgttttggtgggtccaggatgggaagcacatcaagccgcagcggctcatctcggaaattgcgcggatcacaaagggggacgtcgtggtcacaacggacgtcggccaacaccaaatgtgggctgcgcaattcttcccgctgaatcagccggatcggtgggtgacctccggtggactgggcaccatgggttttggcttaccagcggccatcggtgcgcacttcggacagccggataagctcgtggtggcgatcctgggcgacgcggggttccagatgacgctgcaggaactcgccgtgattggcgagcaccagttgcccatcaaggtcgtgatcgtcaacaacagcgcgctgggcatggtgaggcagtggcaggagctgtttcacggcgagcggtactcggaatcgctgcttccgtggcagcctgacttcgtgaagctgggcgaggcgtaccgcattccctcggcgcgcgtggagcgggacgaggatctgaccgcagcgctcgaggcgtttctcagtgaaccgggtccaggtctcctggagtgcgtggtggatccgaacgagaacgtgtaccccatggtcgcgccgggcaccgggatccaccagatggtgggggtgaggccatga

SEQ ID NO: 184 - DNA, 1761 bp, Artificial
  Substituion in SEQ ID NO 172
ttgtggagaggaggaaacgcgatgcctggaatgtcaaaaccggcagatgacgagacgctgacgcgctcgggagaaggcggagccatgtggatgaaaggtgccgacatggtcgtagaggcgctgcgccgcgagcaggtcgaggtcatcttcgggtatcccggtggagcggtgctaccgctgtacgacgcgctctaccaatgtggcattcgccatgtgttgacacgccatgagcaaggcgccattcacgctgcggagggctacgctcgcgtaacgggaaagccgggcgtcgtgatcgccacaagtgggccaggtgccacgaacctcgtcaccgggttggccgacgcgatgatggacagcattccgctcgtcgccatcacgggacaggtggcgaagacggtgattggcaccgatgcgtttcaggagacgtccatcattggcatctcgacgcccatcacaaagcataactatcagattcggcacgcgtcggagattccgaaggtcttcaaagaggcgttccacatcgccaactcgggccgtaaagggcctgtgctgatcgatattcccaaggacgtctcaggggaagaggcgtggttcgcgtatgacgatccgccgcagctgccggggtatcagccgactgtggtgcctcaccacatgcagattcggaagttgatgcacggcttgcaacacgccaagcggcccgtggtgctggcaggagccggcgtcctgcacgcgagggcgaccgagaagctcctggcgttcgtcgaaaagtatcagcttccggtggtgcagaccttgctcggccttggcagctttccggcgtctcacccgctctgcctcggcatgggcggtatgcacggaagcgcggcggccaacaaggcgctgtacgagacggacttcctcatcaatctcggcgcccggtttgacgatcggctgaccggcaagttggagcacttcgcgccgcacgccgtcgtggcgcacatcgacatcgatccggccgagatcggcaaaaacgtcccgaccgacattccggtggtgggcgacgtcggcgatgcgctctccatgatgctcagcatcgacgtcccggcgccggacgcggaggcgtggcgcgaggaactgctgcgggtgaaaagggaacttccgttttggtgggtccaggatgggaagcacatcaagccgcagcggctcatctcggaaattgcgcggatcacaaagggggacgtcgtggtcacaacggacgtcggccaacaccaaatgtgggctgcgcaattcttcccgctgaatcagccggatcggtgggtgacctccggtggactgggcaccatgggttttggcttaccagcggccatcggtgcgcacttcggacagccggataagctcgtggtggcgatcctgggcgacgcggggttccagatgacgctgcaggaactcgccgtgattggcgagcaccagttgcccatcaaggtcgtgatcgtcaacaacagcgcgctgggcatggtgaggcagtggcaggagctgtttcacggcgagcggtactcggaatcgctgcttccgtggcagcctgacttcgtgaagctgggcgaggcgtaccgcattccctcggcgcgcgtggagcgggacgaggatctgaccgcagcgctcgaggcgtttctcagtgaaccgggtccaggtctcctggagtgcgtggtggatccgaacgagaacgtgtaccccatggtcgcgccgggcaccgggatccaccagatggtgggggtgaggccatga

SEQ ID NO: 185 - DNA, 1761 bp, Artificial
  Substituion in SEQ ID NO 172
ttgtggagaggaggaaacgcgatgcctggaatgtcaaaaccggcagatgacgagacgctgacgcgctcgggagaaggcggagccatgtggatgcgtggtgccgacatggtcgtagaggcgctgcgccgcgagcaggtcgaggtcatcttcgggtatcccggtggagcggtgctaccgctgtacgacgcgctctaccaatgtggcattcgccatgtgttgacacgccatgagcaaggcgccattcacgctgcggagggctacgctcgcgtaacgggaaagccgggcgtcgtgatcgccacaagtgggccaggtgccacgaacctcgtcaccgggttggccgacgcgatgatggacagcattccgctcgtcgccatcacgggacaggtggcgaagacggtgattggcaccgatgcgtttcaggagacgtccatcattggcatctcgacgcccatcacaaagcataactatcagattcggcacgcgtcggagattccgaaggtcttcaaagaggcgttccacatcgccaactcgggccgtaaagggcctgtgctgatcgatattcccaaggacgtctcaggggaagaggcgtggttcgcgtatgacgatccgccgcagctgccggggtatcagccgactgtggtgcctcaccacatgcagattcggaagttgatgcacggcttgcaacacgccaagcggcccgtggtgctggcaggagccggcgtcctgcacgcgagggcgaccgagaagctcctggcgttcgtcgaaaagtatcagcttccggtggtgcagaccttgctcggccttggcagctttccggcgtctcacccgctctgcctcggcatgggcggtatgcacggaagcgcggcggccaacaaggcgctgtacgagacggacttcctcatcaatctcggcgcccggtttgacgatcggctgaccggcaagttggagcacttcgcgccgcacgccgtcgtggcgcacatcgacatcgatccggccgagatcggcaaaaacgtcccgaccgacattccggtggtgggcgacgtcggcgaggcgctctccatgatgctcagcatcgacgtcccggcgccggacgcggaggcgtggcgcgaggaactgctgcgggtgaaaagggaacttccgttttggtgggtccaggatgggaagcacatcaagccgcagcggctcatctcggaaattgcgcggatcacaaagggggacgtcgtggtcacaacggacgtcggccaacaccaaatgtgggctgcgcaattcttcccgctgaatcagccggatcggtgggtgacctccggtggactgggcaccatgggttttggcttaccagcggccatcggtgcgcacttcggacagccggataagctcgtggtggcgatcctgggcgacgcggggttccagatgacgctgcaggaactcgccgtgattggcgagcaccagttgcccatcaaggtcgtgatcgtcaacaacagcgcgctgggcatggtgaggcagtggcaggagctgtttcacggcgagcggtactcggaatcgctgcttccgtggcagcctgacttcgtgaagctgggcgaggcgtaccgcattccctcggcgcgcgtggagcgggacgaggatctgaccgcagcgctcgaggcgtttctcagtgaaccgggtccaggtctcctggagtgcgtggtggatccgaacgagaacgtgtaccccatggtcgcgccgggcaccgggatccaccagatggtgggggtgaggccatga

SEQ ID NO: 186 - DNA, 1761 bp, Artificial
  Substituion in SEQ ID NO 172
ttgtggagaggaggaaacgcgatgcctggaatgtcaaaaccggcagatgacgagacgctgacgcgctcgggagaaggcggagccatgtggatgaaaggtgccgacatggtcgtagaggcgctgcgccgcgagcaggtcgaggtcatcttcgggtatcccggtggagcggtgctaccgctgtacgacgcgctctaccaatgtggcattcgccatgtgttgacacgccatgagcaaggcgccattcacgctgcggagggctacgctcgcgtaacgggaaagccgggcgtcgtgatcgccacaagtgggccaggtgccacgaacctcgtcaccgggttggccgacgcgatgatggacagcattccgctcgtcgccatcacgggacaggtggcgaagacggtgattggcaccgatgcgtttcaggagacgtccatcattggcatctcgacgcccatcacaaagcataactatcagattcggcacgcgtcggagattccgaaggtcttcaaagaggcgttccacatcgccaactcgggccgtaaagggcctgtgctgatcgatattcccaaggacgtctcaggggaagaggcgtggttcgcgtatgacgatccgccgcagctgccggggtatcagccgactgtggtgcctcaccacatgcagattcggaagttgatgcacggcttgcaacacgccaagcggcccgtggtgctggcaggagccggcgtcctgcacgcgagggcgaccgagaagctcctggcgttcgtcgaaaagtatcagcttccggtgattcagaccttgctcggccttggcagctttccggcgtctcacccgctctgcctcggcatgggcggtatgcacggaagcgcggcggccaacaaggcgctgtacgagacggacttcctcatcaatctcggcgcccggtttgacgatcggctgaccggcaagttggagcacttcgcgccgcacgccgtcgtggcgcacatcgacatcgatccggccgagatcggcaaaaacgtcccgaccgacattccggtggtgggcgacgtcggcgaggcgctctccatgatgctcagcatcgacgtcccggcgccggacgcggaggcgtggcgcgaggaactgctgcgggtgaaaagggaacttccgttttggtgggtccaggatgggaagcacatcaagccgcagcggctcatctcggaaattgcgcggatcacaaagggggacgtcgtggtcacaacggacgtcggccaacaccaaatgtgggctgcgcaattcttcccgctgaatcagccggatcggtgggtgacctccggtggactgggcaccatgggttttggcttaccagcggccatcggtgcgcacttcggacagccggataagctcgtggtggcgatcctgggcgacgcggggttccagatgacgctgcaggaactcgccgtgattggcgagcaccagttgcccatcaaggtcgtgatcgtcaacaacagcgcgctgggcatggtgaggcagtggcaggagctgtttcacggcgagcggtactcggaatcgctgcttccgtggcagcctgacttcgtgaagctgggcgaggcgtaccgcattccctcggcgcgcgtggagcgggacgaggatctgaccgcagcgctcgaggcgtttctcagtgaaccgggtccaggtctcctggagtgcgtggtggatccgaacgagaacgtgtaccccatggtcgcgccgggcaccgggatccaccagatggtgggggtgaggccatga

SEQ ID NO: 187 - DNA, 1761 bp, Artificial
  Substituion in SEQ ID NO 172
ttgtggagaggaggaaacgcgatgcctggaatgtcaaaaccggcagatgacgagacgctgacgcgctcgggagatggcggagccatgtggatgaaaggtgccgacatggtcgtagaggcgctgcgccgcgagcaggtcgaggtcatcttcgggtatcccggtggagcggtgctaccgctgtacgacgcgctctaccaatgtggcattcgccatgtgttgacacgccatgagcaaggcgccattcacgctgcggagggctacgctcgcgtaacgggaaagccgggcgtcgtgatcgccacaagtgggccaggtgccacgaacctcgtcaccgggttggccgacgcgatgatggacagcattccgctcgtcgccatcacgggacaggtggcgaagacggtgattggcaccgatgcgtttcaggagacgtccatcattggcatctcgacgcccatcacaaagcataactatcagattcggcacgcgtcggagattccgaaggtcttcaaagaggcgttccacatcgccaactcgggccgtaaagggcctgtgctgatcgatattcccaaggacgtctcaggggaagaggcgtggttcgcgtatgacgatccgccgcagctgccggggtatcagccgactgtggtgcctcaccacatgcagattcggaagttgatgcacggcttgcaacacgccaagcggcccgtggtgctggcaggagccggcgtcctgcacgcgagggcgaccgagaagctcctggcgttcgtcgaaaagtatcagcttccggtggtgcagaccttgctcggccttggcagctttccggcgtctcacccgctctgcctcggcatgggcggtatgcacggaagcgcggcggccaacaaggcgctgtacgagacggacttcctcatcaatctcggcgcccggtttgacgatcggctgaccggcaagttggagcacttcgcgccgcacgccgtcgtggcgcacatcgacatcgatccggccgagatcggcaaaaacgtcccgaccgacattccggtggtgggcgacgtcggcgaggcgctctccatgatgctcagcatcgacgtcccggcgccggacgcggaggcgtggcgcgaggaactgctgcgggtgaaaagggaacttccgttttggtgggtccaggatgggaagcacatcaagccgcagcggctcatctcggaaattgcgcggatcacaaagggggacgtcgtggtcacaacggacgtcggccaacaccaaatgtgggctgcgcaattcttcccgctgaatcagccggatcggtgggtgacctccggtggactgggcaccatgggttttggcttaccagcggccatcggtgcgcacttcggacagccggataagctcgtggtggcgatcctgggcgacgcggggttccagatgacgctgcaggaactcgccgtgattggcgagcaccagttgcccatcaaggtcgtgatcgtcaacaacagcgcgctgggcatggtgaggcagtggcaggagctgtttcacggcgagcggtactcggaatcgctgcttccgtggcagcctgacttcgtgaagctgggcgaggcgtaccgcattccctcggcgcgcgtggagcgggacgaggatctgaccgcagcgctcgaggcgtttctcagtgaaccgggtccaggtctcctggagtgcgtggtggatccgaacgagaacgtgtaccccatggtcgcgccgggcaccgggatccaccagatggtgggggtgaggccatga

SEQ ID NO: 188 - protein, 319 aa, Alicyclobacillus acidocaldarius
MNVAFVFPGQGAQYVGMGRAIFDEYPVARALLEEADEALGMKLSDIIFEGPEDTLRLTYYTQPALLTVSVAVWRALVDRVDIQPLAVAGHSLGEYSALVAAKSISFADAVKLVYQRGKLMDEAYPAGQGTMAAVLGLDEEPLREVCKRASEETGEIVELANVNCPGQIVISGAKAAVERASLLAKEAGARRVMPLNVSGPFHSSLMQPAADRLGALLDEIEFADAETPVVANVDGHPRRMASDLRDALKKQLVMPVRFVDCVLSMKRLGVDCVVELGPGTVLSGLVRKIDKSLETAHAEDPATLDEVCALLTRGGESGE

SEQ ID NO: 189 - DNA, 960 bp, Alicyclobacillus acidocaldarius
atgaacgtcgcattcgtgtttccaggacaaggcgcccagtacgtcggcatggggcgagccatctttgacgagtatcccgtggcgcgcgcgcttctcgaggaagccgacgaggcgctcggcatgaaattgtcggacatcatcttcgagggtcccgaggacacgcttcgcctcacctattacacgcagcccgcccttctgacggtcagtgtggccgtgtggcgcgccctggttgatcgcgtcgatattcagccgctcgcggtggccggccacagcctcggcgaatactcggcgctcgtcgcggccaagagcatttccttcgcggacgcggtgaaactcgtgtatcagcgcggaaagctgatggacgaggcgtatccggcggggcagggcaccatggcggcggtcctggggctcgacgaggagccgcttcgagaggtgtgcaagcgcgcgagcgaggaaacgggcgagattgtcgagttggcgaacgtgaactgccctgggcagattgtcatttcgggggccaaggccgccgtggaacgcgcctctcttctggcgaaggaggccggagctcgccgagtgatgcccctcaacgtcagcgggccgtttcactcgagcctgatgcagccagccgccgatcggctgggggcgctcctcgacgagatcgagtttgcggacgccgagacgcccgtggtggcgaacgtggacgggcatccgcggcggatggcgtccgatctgcgcgatgcgctgaagaagcaactcgtgatgccggtccgcttcgtggactgcgtgctgtcgatgaagcgattgggcgtggattgcgtcgtggagttggggcccgggacggtgctcagcgggctggtgcgcaaaatcgacaagtcgcttgagacggcccacgccgaggatccggcgacgctggatgaggtgtgcgcgctgttgacgcgtggaggtgaaagcggtgagtga

SEQ ID NO: 190 - protein, 307 aa, Bacillus clausii KSM-K16
IAFLFPGQGSQKVGMGATLFAEDSLAKEVLERADKALGFPLSEIIEHGPEEKLKQTAYAQPALVTMSTAVLQLFRDAGIQADFVAGHSLGEYSALVACKSLTFEDAVTLVHQRGTLMEEAVPQGQGAMAAVLGLNKEELEEVASEIAADGEVAELANLNCPGQIVLSGTAKGIEQAAVLAKQKGAKRVLPLAVSGPFHSSLMKPAADQFKQALEQAPFANPTVPLIANVTAEVTDAPEVIREQLAEQIYSPVRFEESVRRMIELGVDTFIEIGAGNVLCGLVRKIDRNLRTFAVSDRESFEKMAAAL

SEQ ID NO: 191 - protein, 300 aa, Bacillus halodurans C-125
VAFLFPGQGSQSVGMGSELLSEEKAKEIFDEADERLGYSLSSIMFEGPEEKLRRTENTQPALLTMSTAVLSLVREYGIKPDYTAGHSLGEYSALVASGSLTFADAVYAVHHRGLFMEEAVPFGEGAMAAILGMERDELEQVTKRVTEAGAVVELANLNCPGQIVISGSAEGVEQASEEAKEAGAKRVIPLQVSGPFHSSLMKPAAEKLEAVLADLAIADAAPPVIANVTADLVQKAADIRSSLIEQVYSPVRWEDTVRRMLELGVDTFVEIGSGNVLSGLVRKVQRRVNVFSVSDRASIE

SEQ ID NO: 192 - protein, 301 aa, Bacillus subtilis subsp. subtilis str. 168
IAFLFPGQGSQFIGMGKELYEQVPAAKRLFDEADETLETKLSSLIFEGDAEELTLTYNAQPALLTTSIAVLEKFKESGITPDFTAGHSLGEYSALVAAGALSFKDAVYTVRKRGEFMNEAVPAGEGAMAAILGMDAEALKQVTDKVTEEGNLVQLANLNCPGQIVISGTAKGVELASELAKENGAKRAIPLEVSGPFHSELMKPAAEKLKEVLDACDIKDADVPVISNVSADVMTEKADIKEKLIEQLYSPVRFEESINKLIAEGVTTFIEIGPGKVLSGLVKKVNRRLKTIAVSDPETIE

SEQ ID NO: 193 - protein, 296 aa, Bacillus sp. SG-1
IAFVFPGQGSQKAGMGKELSEKFPQVEEYFKKADQRLGFDLSTLIFEGPQDKLTLTENAQPALLTTSIAFLQMLESEGVKPDYTAGHSLGEYSALVAAGAISFEDGVYAVRKRGEYMEEAVPAGEGTMAAVLGMGRDQLSEITERISAEGNHVGLANLNCPGQIVISGSFRGVELASDLAKEEGAKRVLPLQVSGPFHSSMMKPAAENFSGVLDEIAIRDAEVPVIANVNAEPMISASEIKERLIQQLYSPVLWEDTVVKLLDAGVDTFIEIGPGKVLSGLIKKVNRRVNTFSISD

SEQ ID NO: 194 - protein, 307 aa, Geobacillus kaustophilus HTA426
IAFLFPGQGSQTVGMAKDAAEHDDRARAVIAEADERLGFALSKLMFNGPQEELTLTYNAQPALLTASIALLQLVDGAGLKADYVAGHSLGEYTALVAAGAMSFADAVYAVRRRGELMDEAVPAGEGTMAAVLGMDADALEAVTNEIAAQGDPVEPANFNCPGQIVISGSKAGVEKAAQLLKERGAKRVIPLEVSGPFHSALMKPAAEKLKAVLDSLVIRDAVIPVVANVTAEPVTKKEDIARLLIEQLYSPVRWEQSVRTLLSLGVDTFVEIGPGKVLSGLVKKIDRNARVYAVNDLASFEATVAAL

SEQ ID NO: 195 - protein, 319 aa, Artificial
  Substituion in SEQ ID NO 188
MNVAFVFPGQGAQYVGMGRAIFDEYPVARALLEEADEALGMKLSDIIFEGPEDTLRLTYYTQPALLTVSVAVWRALVDRVDIQPLAVAGHSLGEYSALVAAKSISFADAVKLVYQRGKLMDEAYPAGQGTMAAVLGLDEEPLREVCKRASEETGEIVELANVNCPGQIVISGAKAAVERASLLAKEAGARRVMPLNVSGPFHSSLMQPAADRLGALLDEIEFADAETPVVANVDGHPRRMASDLRDALKKQLVMPVRFVDCVISMKRLGVDCVVELGPGTVLSGLVRKIDKSLETAHAEDPATLDEVCALLTRGGESGE

SEQ ID NO: 196 - protein, 319 aa, Artificial
  Substituion in SEQ ID NO 188
MNVAFVFPGQGAQYVGMGRAIFDEYPVARALLEEADEALGMKLSDIIFEGPEDTLRLTYYTQPALLTVSVAVWRALIDRVDIQPLAVAGHSLGEYSALVAAKSISFADAVKLVYQRGKLMDEAYPAGQGTMAAVLGLDEEPLREVCKRASEETGEIVELANVNCPGQIVISGAKAAVERASLLAKEAGARRVMPLNVSGPFHSSLMQPAADRLGALLDEIEFADAETPVVANVDGHPRRMASDLRDALKKQLVMPVRFVDCVLSMKRLGVDCVVELGPGTVLSGLVRKIDKSLETAHAEDPATLDEVCALLTRGGESGE

SEQ ID NO: 197 - protein, 319 aa, Artificial
  Substituion in SEQ ID NO 188
MNVAFVFPGQGAQYVGMGRAIFDEYPVARALLEEADEALGMKLSDIIFEGPEDTLRLTYYTQPALLTVSVAVWRALVDRVDIQPLAVAGHSLGEYSALVAAKSISFADAVKLVYQRGKLMDEAYPAGQGTMAAVLGLDEEPLREVCKRASEETGEIVELANVNCPGQIVISGAKAAVERASLLAKEAGARRVMPLNVSGPFHSSLMQPAADRLGALLDEIEFADAETPVVANVDGHPRRMASDLRDALKKQLVMPVRFVDCVLSMRRLGVDCVVELGPGTVLSGLVRKIDKSLETAHAEDPATLDEVCALLTRGGESGE

SEQ ID NO: 198 - protein, 319 aa, Artificial
  Substituion in SEQ ID NO 188
MNVAFVFPGQGAQYVGMGRAIFDEYPVARALLEEADEALGMKLSDIIFEGPEDTLRLTYYTQPALLTVSVAVWRALVDRVDIQPLAVAGHSLGEYSALVAAKSISFADAVKLVYQRGKLMDEAYPAGQGTMAAVLGLDEEPLKEVCKRASEETGEIVELANVNCPGQIVISGAKAAVERASLLAKEAGARRVMPLNVSGPFHSSLMQPAADRLGALLDEIEFADAETPVVANVDGHPRRMASDLRDALKKQLVMPVRFVDCVLSMKRLGVDCVVELGPGTVLSGLVRKIDKSLETAHAEDPATLDEVCALLTRGGESGE

SEQ ID NO: 199 - protein, 319 aa, Artificial
  Substituion in SEQ ID NO 188
MNVAFVFPGQGAQYVGMGRAIFDEYPVARALLEEADEALGMKLSDIIFEGPEDTLRLTYYTQPALLTVSVAVWRALVDRVDIQPLAVAGHSLGEYSALVAAKSISFADAVKLVYQRGKLMDEAYPAGQGTMAAVLGLDEEPLREVCKRASEETGEIVELANVNCPGQIVISGAKAAVERASLLAKEAGARRVMPLNVSGPFHSSLMQPAADRLGALLDEIEFADAETPVVANVDGHPRRMASDLRDALKKQLVMPVRFVDCVLSMKRLGVDCVVELGPGTVLSGLVRKIDKSLETAHAEDPATIDEVCALLTRGGESGE

SEQ ID NO: 200 - DNA, 960 bp, Artificial
  Substituion in SEQ ID NO 189
atgaacgtcgcattcgtgtttccaggacaaggcgcccagtacgtcggcatggggcgagccatctttgacgagtatcccgtggcgcgcgcgcttctcgaggaagccgacgaggcgctcggcatgaaattgtcggacatcatcttcgagggtcccgaggacacgcttcgcctcacctattacacgcagcccgcccttctgacggtcagtgtggccgtgtggcgcgccctggttgatcgcgtcgatattcagccgctcgcggtggccggccacagcctcggcgaatactcggcgctcgtcgcggccaagagcatttccttcgcggacgcggtgaaactcgtgtatcagcgcggaaagctgatggacgaggcgtatccggcggggcagggcaccatggcggcggtcctggggctcgacgaggagccgcttcgagaggtgtgcaagcgcgcgagcgaggaaacgggcgagattgtcgagttggcgaacgtgaactgccctgggcagattgtcatttcgggggccaaggccgccgtggaacgcgcctctcttctggcgaaggaggccggagctcgccgagtgatgcccctcaacgtcagcgggccgtttcactcgagcctgatgcagccagccgccgatcggctgggggcgctcctcgacgagatcgagtttgcggacgccgagacgcccgtggtggcgaacgtggacgggcatccgcggcggatggcgtccgatctgcgcgatgcgctgaagaagcaactcgtgatgccggtccgcttcgtggactgcgtgatttcgatgaagcgattgggcgtggattgcgtcgtggagttggggcccgggacggtgctcagcgggctggtgcgcaaaatcgacaagtcgcttgagacggcccacgccgaggatccggcgacgctggatgaggtgtgcgcgctgttgacgcgtggaggtgaaagcggtgagtga

SEQ ID NO: 201 - DNA, 960 bp, Artificial
  Substituion in SEQ ID NO 189
atgaacgtcgcattcgtgtttccaggacaaggcgcccagtacgtcggcatggggcgagccatctttgacgagtatcccgtggcgcgcgcgcttctcgaggaagccgacgaggcgctcggcatgaaattgtcggacatcatcttcgagggtcccgaggacacgcttcgcctcacctattacacgcagcccgcccttctgacggtcagtgtggccgtgtggcgcgccctgattgatcgcgtcgatattcagccgctcgcggtggccggccacagcctcggcgaatactcggcgctcgtcgcggccaagagcatttccttcgcggacgcggtgaaactcgtgtatcagcgcggaaagctgatggacgaggcgtatccggcggggcagggcaccatggcggcggtcctggggctcgacgaggagccgcttcgagaggtgtgcaagcgcgcgagcgaggaaacgggcgagattgtcgagttggcgaacgtgaactgccctgggcagattgtcatttcgggggccaaggccgccgtggaacgcgcctctcttctggcgaaggaggccggagctcgccgagtgatgcccctcaacgtcagcgggccgtttcactcgagcctgatgcagccagccgccgatcggctgggggcgctcctcgacgagatcgagtttgcggacgccgagacgcccgtggtggcgaacgtggacgggcatccgcggcggatggcgtccgatctgcgcgatgcgctgaagaagcaactcgtgatgccggtccgcttcgtggactgcgtgctgtcgatgaagcgattgggcgtggattgcgtcgtggagttggggcccgggacggtgctcagcgggctggtgcgcaaaatcgacaagtcgcttgagacggcccacgccgaggatccggcgacgctggatgaggtgtgcgcgctgttgacgcgtggaggtgaaagcggtgagtga

SEQ ID NO: 202 - DNA, 960 bp, Artificial
  Substituion in SEQ ID NO 189
atgaacgtcgcattcgtgtttccaggacaaggcgcccagtacgtcggcatggggcgagccatctttgacgagtatcccgtggcgcgcgcgcttctcgaggaagccgacgaggcgctcggcatgaaattgtcggacatcatcttcgagggtcccgaggacacgcttcgcctcacctattacacgcagcccgcccttctgacggtcagtgtggccgtgtggcgcgccctggttgatcgcgtcgatattcagccgctcgcggtggccggccacagcctcggcgaatactcggcgctcgtcgcggccaagagcatttccttcgcggacgcggtgaaactcgtgtatcagcgcggaaagctgatggacgaggcgtatccggcggggcagggcaccatggcggcggtcctggggctcgacgaggagccgcttcgagaggtgtgcaagcgcgcgagcgaggaaacgggcgagattgtcgagttggcgaacgtgaactgccctgggcagattgtcatttcgggggccaaggccgccgtggaacgcgcctctcttctggcgaaggaggccggagctcgccgagtgatgcccctcaacgtcagcgggccgtttcactcgagcctgatgcagccagccgccgatcggctgggggcgctcctcgacgagatcgagtttgcggacgccgagacgcccgtggtggcgaacgtggacgggcatccgcggcggatggcgtccgatctgcgcgatgcgctgaagaagcaactcgtgatgccggtccgcttcgtggactgcgtgctgtcgatgcgtcgattgggcgtggattgcgtcgtggagttggggcccgggacggtgctcagcgggctggtgcgcaaaatcgacaagtcgcttgagacggcccacgccgaggatccggcgacgctggatgaggtgtgcgcgctgttgacgcgtggaggtgaaagcggtgagtga

SEQ ID NO: 203 - DNA, 960 bp, Artificial
  Substituion in SEQ ID NO 189
atgaacgtcgcattcgtgtttccaggacaaggcgcccagtacgtcggcatggggcgagccatctttgacgagtatcccgtggcgcgcgcgcttctcgaggaagccgacgaggcgctcggcatgaaattgtcggacatcatcttcgagggtcccgaggacacgcttcgcctcacctattacacgcagcccgcccttctgacggtcagtgtggccgtgtggcgcgccctggttgatcgcgtcgatattcagccgctcgcggtggccggccacagcctcggcgaatactcggcgctcgtcgcggccaagagcatttccttcgcggacgcggtgaaactcgtgtatcagcgcggaaagctgatggacgaggcgtatccggcggggcagggcaccatggcggcggtcctggggctcgacgaggagccgcttaaagaggtgtgcaagcgcgcgagcgaggaaacgggcgagattgtcgagttggcgaacgtgaactgccctgggcagattgtcatttcgggggccaaggccgccgtggaacgcgcctctcttctggcgaaggaggccggagctcgccgagtgatgcccctcaacgtcagcgggccgtttcactcgagcctgatgcagccagccgccgatcggctgggggcgctcctcgacgagatcgagtttgcggacgccgagacgcccgtggtggcgaacgtggacgggcatccgcggcggatggcgtccgatctgcgcgatgcgctgaagaagcaactcgtgatgccggtccgcttcgtggactgcgtgctgtcgatgaagcgattgggcgtggattgcgtcgtggagttggggcccgggacggtgctcagcgggctggtgcgcaaaatcgacaagtcgcttgagacggcccacgccgaggatccggcgacgctggatgaggtgtgcgcgctgttgacgcgtggaggtgaaagcggtgagtga

SEQ ID NO: 204 - DNA, 960 bp, Artificial
  Substituion in SEQ ID NO 189
atgaacgtcgcattcgtgtttccaggacaaggcgcccagtacgtcggcatggggcgagccatctttgacgagtatcccgtggcgcgcgcgcttctcgaggaagccgacgaggcgctcggcatgaaattgtcggacatcatcttcgagggtcccgaggacacgcttcgcctcacctattacacgcagcccgcccttctgacggtcagtgtggccgtgtggcgcgccctggttgatcgcgtcgatattcagccgctcgcggtggccggccacagcctcggcgaatactcggcgctcgtcgcggccaagagcatttccttcgcggacgcggtgaaactcgtgtatcagcgcggaaagctgatggacgaggcgtatccggcggggcagggcaccatggcggcggtcctggggctcgacgaggagccgcttcgagaggtgtgcaagcgcgcgagcgaggaaacgggcgagattgtcgagttggcgaacgtgaactgccctgggcagattgtcatttcgggggccaaggccgccgtggaacgcgcctctcttctggcgaaggaggccggagctcgccgagtgatgcccctcaacgtcagcgggccgtttcactcgagcctgatgcagccagccgccgatcggctgggggcgctcctcgacgagatcgagtttgcggacgccgagacgcccgtggtggcgaacgtggacgggcatccgcggcggatggcgtccgatctgcgcgatgcgctgaagaagcaactcgtgatgccggtccgcttcgtggactgcgtgctgtcgatgaagcgattgggcgtggattgcgtcgtggagttggggcccgggacggtgctcagcgggctggtgcgcaaaatcgacaagtcgcttgagacggcccacgccgaggatccggcgacgattgatgaggtgtgcgcgctgttgacgcgtggaggtgaaagcggtgagtga

SEQ ID NO: 205 - protein, 176 aa, Alicyclobacillus acidocaldarius
MTPVLSVLVHNKPGVLNRITALFMRKGFNIQSLTVCITENPEISRMTIVMSDMDEAALEQVIKQLHKQIDVLKVTDLTDQAMVARELALIRVSSPIAERAVIHSLIEPFRANIVDVGRETVTVQVTGDAEKIDALIALLRPYGIRELARTGLTALPREAASSADPKRAGEAQVLHI

SEQ ID NO: 206 - DNA, 531 bp, Alicyclobacillus acidocaldarius
atgacgcctgtcctgtcggtgctcgtgcacaacaaacccggggtcctcaaccgcatcaccgcgctcttcatgcgcaagggattcaacatccagagcctcaccgtctgcatcacggaaaatccggagatttcgcgcatgacgattgtcatgagcgacatggacgaggctgcgctggagcaggtgatcaagcagcttcacaaacagatcgacgtgctgaaggtgacggatctcacggatcaggcgatggtcgcacgtgagctggcgctcatccgggtgtcgagccccatcgccgagcgggcggtcatccattcgctcatcgagccgttccgggcgaacatcgtcgatgttgggcgagagacggtgacggtgcaggtcacgggcgatgcggaaaagatcgacgcgctcatcgcgctgctcaggccgtatggcattcgagaattggcgcgcacggggttgacggcgctgccgcgcgaggcggcgtcctcggctgacccgaagcgcgccggagaggcccaggtcctccacatctaa

SEQ ID NO: 207 - protein, 159 aa, Geobacillus kaustophilus HTA426
MRRIITMTVNNRPGVLNRITGLFTKRHYNIESITVGHTEIEGISRMTFVVNVDDERTAEQIIKQLNKQIDVLKVNDITDQAIVARELALIKVAAPPAVRQEIYTLIEPFRASIVDVSKDSLVIQVTGEPEKVEALIELLRPYGIKEVARTGTTAFTRGA

SEQ ID NO: 208 - protein, 157 aa, Bacillus halodurans C-125
MKRTITALVNNTSGVLNRITGLFARRHFNIESITVGVTENPTVSRMTFVVIVDNQKNIEQVIKQLHKQVDVLKVKDITDEAIVARELALIKVVASPQQRGEIAAVVNPFRASIIDIGRESMTVQITGDHQKVETFIDLLRPYGIKELARTGITAFKR

SEQ ID NO: 209 - protein, 167 aa, Geobacillus thermodenitrificans NG80-2
MRRIITMTVNNRPGVLNRITGLFTKRHYNIESITVGHTEIDGVSRMTFVVNVDDERIAEQIIKQLNKQIDVLKVSDITDQAIVARELALVKVAAAPATRQEIYTLIEPFRASIVDVSKDSLVIQVTGEPEKVEALIELLRPYGIKEVARTGTTAFTRGAQKAGSNQK

SEQ ID NO: 210 - protein, 167 aa, Bacillus clausii KSM-K16
MKRTITVLVNNKSGVLNRMTGLFARRQYNIDSITVGVTENPTISRMTFVVFVDSMENVEQMIKQLHKQVDVLKIKDITDEAIVERELALVRVGATPQQRGEIASLAETFRAQAVDIGKESMTLQITGNNEKIEAFIELVKPYGIQELARTGVTAVNRSSKVSTDTSR

SEQ ID NO: 211 - protein, 156 aa, Bacillus anthracis str. Ames
MKRIVTATVRNQSGVLNRITGVMTRRHFNIESISVGHTESSDISRMTIVVHVENEQQVEQLIKQLHKQIDVLKVSDITEEAMIARELALIKVATSVARAELYSLIEPFRAAVIDVGKDSIVVQVTGTQEKVEALIELLRPYGLKEIARTGVTAFTR

SEQ ID NO: 212 - protein, 176 aa, Artificial
  Substituion in SEQ ID NO 205
MTPVLSVLVHNKPGVLNRITALFMRKGFNIQSLTVCITENPEISRMTIVMSDMDEAALEQVIKQLHKQIDVLKVTDLTDQAMVARELALIRVSSPIAERAVIHSLIEPFRANIVDVGRETVTVQVTGDAEKIDALIALLRPYGIRELARTGLTALPREAASSADPKKAGEAQVLHI

SEQ ID NO: 213 - protein, 176 aa, Artificial
  Substituion in SEQ ID NO 205
MTPVLSVLVHNKPGVLNRITALFMRKGFNIQSLTVCITENPEISRMTIVMSDMDEAALEQVIKQLHKQIDVLKVTDLTDQAMVARELALIRVSSPIAERAVIHSLIEPFRANIVDVGRETVTVQVTGDAEKIDALIALLRPYGIRELARTGLTALPREAASSADPKRAGEAQILHI

SEQ ID NO: 214 - protein, 176 aa, Artificial
  Substituion in SEQ ID NO 205
MTPVLSVLVHNKPGVLNRITALFMRKGFNIQSLTVCITENPEISRMTIVMSDMDEAALEQVIKQLHKQIDVLKVTDLTDQAMVARELALIRVSSPIAERAVIHSLIEPFRANIVDVGRETVTVQVTGEAEKIDALIALLRPYGIRELARTGLTALPREAASSADPKRAGEAQVLHI

SEQ ID NO: 215 - protein, 176 aa, Artificial
  Substituion in SEQ ID NO 205
MTPVLSVLVHNKPGVLNRITALFMRKGFNIQSLTVCITENPEISRMTIVMSDMDEAALEQVIKQLHKQIDVLKVTDLTDQAMVARELALIRVSSPIAERAVIHSLIEPFRANIVDVGRETVTVQVTGDAEKIDALIALLRPYGIRELARTGLTALPREAASSADPKRAGEAQVLHL

SEQ ID NO: 216 - protein, 176 aa, Artificial
  Substituion in SEQ ID NO 205
MTPVLSVLVHNKPGVLNRITALFMRKGFNIQSLTVCITENPEISRMTIVMSDMDEAALEQVIKQLHKQIDVLKVTDLTDQAMVARELALIRVSSPIAERAVIHSLIEPFRANIVDVGRETVTVQVTGDAEKIDALIALLRPYGIRELARTGLTALPREAASSADPKRAGEANVLHI

SEQ ID NO: 217 - DNA, 531 bp, Artificial
  Substituion in SEQ ID NO 206
atgacgcctgtcctgtcggtgctcgtgcacaacaaacccggggtcctcaaccgcatcaccgcgctcttcatgcgcaagggattcaacatccagagcctcaccgtctgcatcacggaaaatccggagatttcgcgcatgacgattgtcatgagcgacatggacgaggctgcgctggagcaggtgatcaagcagcttcacaaacagatcgacgtgctgaaggtgacggatctcacggatcaggcgatggtcgcacgtgagctggcgctcatccgggtgtcgagccccatcgccgagcgggcggtcatccattcgctcatcgagccgttccgggcgaacatcgtcgatgttgggcgagagacggtgacggtgcaggtcacgggcgatgcggaaaagatcgacgcgctcatcgcgctgctcaggccgtatggcattcgagaattggcgcgcacggggttgacggcgctgccgcgcgaggcggcgtcctcggctgacccgaagaaagccggagaggcccaggtcctccacatctaa

SEQ ID NO: 218 - DNA, 531 bp, Artificial
  Substituion in SEQ ID NO 206
atgacgcctgtcctgtcggtgctcgtgcacaacaaacccggggtcctcaaccgcatcaccgcgctcttcatgcgcaagggattcaacatccagagcctcaccgtctgcatcacggaaaatccggagatttcgcgcatgacgattgtcatgagcgacatggacgaggctgcgctggagcaggtgatcaagcagcttcacaaacagatcgacgtgctgaaggtgacggatctcacggatcaggcgatggtcgcacgtgagctggcgctcatccgggtgtcgagccccatcgccgagcgggcggtcatccattcgctcatcgagccgttccgggcgaacatcgtcgatgttgggcgagagacggtgacggtgcaggtcacgggcgatgcggaaaagatcgacgcgctcatcgcgctgctcaggccgtatggcattcgagaattggcgcgcacggggttgacggcgctgccgcgcgaggcggcgtcctcggctgacccgaagcgcgccggagaggcccagattctccacatctaa

SEQ ID NO: 219 - DNA, 531 bp, Artificial
  Substituion in SEQ ID NO 206
atgacgcctgtcctgtcggtgctcgtgcacaacaaacccggggtcctcaaccgcatcaccgcgctcttcatgcgcaagggattcaacatccagagcctcaccgtctgcatcacggaaaatccggagatttcgcgcatgacgattgtcatgagcgacatggacgaggctgcgctggagcaggtgatcaagcagcttcacaaacagatcgacgtgctgaaggtgacggatctcacggatcaggcgatggtcgcacgtgagctggcgctcatccgggtgtcgagccccatcgccgagcgggcggtcatccattcgctcatcgagccgttccgggcgaacatcgtcgatgttgggcgagagacggtgacggtgcaggtcacgggcgaagcggaaaagatcgacgcgctcatcgcgctgctcaggccgtatggcattcgagaattggcgcgcacggggttgacggcgctgccgcgcgaggcggcgtcctcggctgacccgaagcgcgccggagaggcccaggtcctccacatctaa

SEQ ID NO: 220 - DNA, 531 bp, Artificial
  Substituion in SEQ ID NO 206
atgacgcctgtcctgtcggtgctcgtgcacaacaaacccggggtcctcaaccgcatcaccgcgctcttcatgcgcaagggattcaacatccagagcctcaccgtctgcatcacggaaaatccggagatttcgcgcatgacgattgtcatgagcgacatggacgaggctgcgctggagcaggtgatcaagcagcttcacaaacagatcgacgtgctgaaggtgacggatctcacggatcaggcgatggtcgcacgtgagctggcgctcatccgggtgtcgagccccatcgccgagcgggcggtcatccattcgctcatcgagccgttccgggcgaacatcgtcgatgttgggcgagagacggtgacggtgcaggtcacgggcgatgcggaaaagatcgacgcgctcatcgcgctgctcaggccgtatggcattcgagaattggcgcgcacggggttgacggcgctgccgcgcgaggcggcgtcctcggctgacccgaagcgcgccggagaggcccaggtcctccacttataa

SEQ ID NO: 221 - DNA, 531 bp, Artificial
  Substituion in SEQ ID NO 206
atgacgcctgtcctgtcggtgctcgtgcacaacaaacccggggtcctcaaccgcatcaccgcgctcttcatgcgcaagggattcaacatccagagcctcaccgtctgcatcacggaaaatccggagatttcgcgcatgacgattgtcatgagcgacatggacgaggctgcgctggagcaggtgatcaagcagcttcacaaacagatcgacgtgctgaaggtgacggatctcacggatcaggcgatggtcgcacgtgagctggcgctcatccgggtgtcgagccccatcgccgagcgggcggtcatccattcgctcatcgagccgttccgggcgaacatcgtcgatgttgggcgagagacggtgacggtgcaggtcacgggcgatgcggaaaagatcgacgcgctcatcgcgctgctcaggccgtatggcattcgagaattggcgcgcacggggttgacggcgctgccgcgcgaggcggcgtcctcggctgacccgaagcgcgccggagaggccaatgtcctccacatctaa

SEQ ID NO: 222 - protein, 365 aa, Alicyclobacillus acidocaldarius
MKGTDGMTKNIAILPGDGIGREVTAEAVKLIQVVAASRGETWNLEEGLIGGSALDATGSPLPEETVRLCRAADAVLLGAVGGPKWDHLPGDKRPEAGLLGIRKALEVYANLRPIRTWPGLLLASPLKPELVEGVDFIIVRELTGGLYFGQPKARLDGGEAVVDTLHYTRAEIRRVVKVAFELAKGRQGRLTSVDKANVLESSRVWREVVEEVASEYPGVLVEHLLVDNAAMQIITRPKTFDVIVTENMFGDILSDEAAVITGSIGMLPSASLGEAGPGLYEPVHGSAPDIAGQGLANPLATFLSVALMMRHSLHLPEAADAIEQAVHGVIERGVRTRDLARSGEAFVKTADVSAMVCEDVKRRLG

SEQ ID NO: 223 - DNA, 1098 bp, Alicyclobacillus acidocaldarius
ttgaaagggacggatggcatgacaaagaacattgcgatcttgccgggagacggcatcggccgagaagtcacggcggaggcggtcaagctgatccaggtcgtcgccgcgagtcggggggagacgtggaacctcgaggaaggtctcattggcggcagcgcgctggacgcgacaggctcgccattgccggaagagacggtgcggctctgccgcgctgcggacgccgtgctgctcggcgcggtgggcggaccgaagtgggaccatctccccggcgacaagcgccctgaggcaggactgctcggcattcgcaaggcgcttgaggtctacgcgaatcttcggcccatccggacctggccagggctgttgctggcctcgccgctcaagccggagcttgtcgagggcgtggatttcatcatcgtgcgggagttgacgggtgggctttatttcggccagccgaaggcgcgcctcgatggcggcgaggcggtggtggacacgcttcattacacgcgcgccgagattcgccgcgtggtgaaggtggcctttgaactcgcgaaaggccggcaggggcgcctgacgtcggtcgacaaggcgaatgtgctcgagtcgagccgcgtgtggcgcgaggtggtggaggaggttgcgtccgaatatcccggcgttttggtggagcatctgctggtggacaacgccgccatgcagatcatcacgcggccgaagacgttcgacgtgatcgtgacggagaacatgtttggcgacattttgagcgacgaggcggccgtcatcacgggatccatcggcatgctgccttccgcgagcctcggcgaggcaggaccgggcctgtacgagcccgtgcacggctccgcgccggacatcgccggacagggcctcgccaatccgctggcgacgtttctgtccgtggcgctcatgatgcggcattccctgcacctccccgaggctgcggacgccatcgagcaggcggtgcacggcgtgattgagcggggcgtccgcacgcgcgatctcgcccgaagcggcgaggcgttcgtcaagacggcggacgtcagcgccatggtttgcgaagacgtgaaaaggaggctcggttga

SEQ ID NO: 224 - protein, 357 aa, Bacillus halodurans C-125
MEKQIAVLPGDGIGPEVTDAAIEVLQAVADRFGHTFSYKKALLGGCAIDEVGTPLPEETLDVCRHADGILLGAVGGPKWDTLPGHLRPEKGLLGLRKGLNLFANLRPVTVYDSLADASTLKNDVIDGVDLLIVRELTGGLYFGEPRERRGEGETEEVVDTLLYTRGEMRRIIRKAFELAMVRNKHVTSVDKANVLESSRMWREVANEVAQEFPEVTLEHMLVDNAAMQLIRRPKQFDVLVTENLFGDILSDEASMVTGSLGMLPSASLTSDGPGLYEPIHGSAPDIAGKGVANPLATIASCAMMLKYSFGLHEEAKTIEDAIEAVLKQGYRTADIAKPGEESSSTKAITDAVVEAIQ

SEQ ID NO: 225 - protein, 344 aa, Geobacillus kaustophilus HTA426
IAVLPGDGIGKEVTSGAVEVLKAVGIRFGHEFTFEYGLIGGAAIDEAGTPLPEETLRLCRESDAVLLGAVGGPKWDDNPPHLRPEKGLLAIRKQLDLYANLRPVVCYDSLVSASPLKPDLVQGVDFVIVRELTGGIYFGQPSGRVVENGEEKAVDTLLYKKEEIERIVRMAFILARGRKKKVTSVDKANVLSSSRLWREVAEEVAKQFPDVTLEHMLVDNAAMQLIRAPKQFDVIVTENMFGDILSDEASMLSGSLGMLPSASLSASGPSLYEPVHGSAPDIAGMNKANPIAAILSAAMMLRLSFGLTAEAEAVEHAVRQALDQGLRTADLAPSGGRIVSTNEM

SEQ ID NO: 226 - protein, 358 aa, Bacillus sp. NRRL B-14911
MKKRIAVLPGDGIGKEVAAGAVEVLQAAGERFGHTFEFSYGKIGGTAIDSTGVPLPDETVELCKSSDAILLGAVGGPRWEKLHPSLRPERGLLKIRKDLNLYANLRPTSYFASVADSSPLRKEVIEGTDFLMVRELTGGLYFGKPSERAGNGSEETAVDTLFYKKEEVQRVVRLAFELARGRDGKVTSVDKANVLESSRMWRETAEEIAAQYPDIQLEHMLVDNAAMQIIKNPKQFDVIVTENMFGDILSDEASVLTGSLGMLPSASLSEGGPYLYEPIHGSAPDIEGKGIANPVGMILSAAMMLRLSFGMEEEAAAIEKAVSDVLESGIRTADLASGGKAASTKVMTEEIKAALLDN

SEQ ID NO: 227 - protein, 344 aa, Geobacillus thermodenitrificans NG80-2
IAVLPGDGIGKEVTSGAVEVLKAVGIRFGHEFTFEYGLIGGAAIDEVGTPLPEETLRLCQQSDAVLLGAVGGPKWDQNPPHLRPEKGLLAIRQQLGLYANLRPVVCYDSLDSASPLKSDLVQGVDFIIVRELTGGIYFGQPSGRVVENGEEKAVDTLLYKKEEIERIVRMAFTLARGRKKKVTSVDKANVLSSSRLWREVAEEVAKQFPDVELEHMLVDNAAMQLIRAPKQFDVIVTENMFGDILSDEASMLSGSLGMLPSASLSASGPSLYEPVHGSAPDIAGMRKANPIAAILSAAMMLRLSFGLTAEAEAIEHAVQQALTAGLRTADLAQSNGRVVSTDEM

SEQ ID NO: 228 - protein, 340 aa, Gloeobacter violaceus PCC 7421
IAVLPGDGIGTEIVQVGVAMLEAAARRFDFAFDFEEAPIGGAAIDATGEPLPAATLELCKASDAVFLGAVGGPQWDTLPSDKRPEKALLGLRAGLGLFANLRPARILPQLVAASALKPEVVEGVDILVVRELTGGLYFGIPKGIFPEKKGGRRGVNTMSYSAFEIERIGRVAFEAARERRGKLCSVDKANVLEVSQLWREVLVGLAPEYPDVELTHMYVDNCAMQLVRRPRQFDTIVTENMFGDILSDEAAMLTGSIGMLPSASLGSGGPGLYEPVHGSAPDIAGQDKANPLAQVLSGAMLLRHSLRQPEAAQAVERAVQTVLEQGYRTGDIAAPGAQIV

SEQ ID NO: 229 - protein, 365 aa, Artificial
  Substituion in SEQ ID NO 222
MKGTDGMTKNIAILPGDGIGREVTAEAVKLIQVVAASRGETWNLEEGLIGGSALDATGSPLPEETVKLCRAADAVLLGAVGGPKWDHLPGDKRPEAGLLGIRKALEVYANLRPIRTWPGLLLASPLKPELVEGVDFIIVRELTGGLYFGQPKARLDGGEAVVDTLHYTRAEIRRVVKVAFELAKGRQGRLTSVDKANVLESSRVWREVVEEVASEYPGVLVEHLLVDNAAMQIITRPKTFDVIVTENMFGDILSDEAAVITGSIGMLPSASLGEAGPGLYEPVHGSAPDIAGQGLANPLATFLSVALMMRHSLHLPEAADAIEQAVHGVIERGVRTRDLARSGEAFVKTADVSAMVCEDVKRRLG

SEQ ID NO: 230 - protein, 365 aa, Artificial
  Substituion in SEQ ID NO 222
MKGTDGMTKNIAILPGDGIGREVTAEAVKLIQVVAASRGETWNLEEGLIGGSALDATGSPLPEETVRLCRAADAVLLGAVGGPKWDHLPGDKRPEAGLLGIRKALEVYANLRPIRTWPGLLLASPLKPELVEGVDFIIVRELTGGLYFGQPKARLDGGEAVVDTLHYTRAEIRRVVKVAFELAKGRQGRLTSVDKANVLESSRVWREVVEEVASEYPGVLVEHLLVDNAAMQIITRPKTFDVIVTENMFGDILSDEAAVITGSIGMLPSASLGEAGPGLYEPVHGSAPDIAGQGLANPLATFLSVALMMRHSLHLPEAADAIEQAVHGVIERGVRTRDLARSGEAFVKTADVSAMVCEDVKRRIG

SEQ ID NO: 231 - protein, 365 aa, Artificial
  Substituion in SEQ ID NO 222
MKGTDGMTKNIAILPGDGIGREVTAEAVKLIQVVAASRGETWNLEEGLIGGSALDATGSPLPEETVRLCRAADAVLLGAVGGPKWDHLPGDKRPEAGLLGIRKALEVYANLRPIRTWPGLLLASPLKPELVEGVDFIIVRELTGGLYFGQPKARLDGGEAVVDTLHYTRAEIRRVVKVAFELAKGRQGRLTSVDKANVLESSRVWREVVEEVASEYPGVLVEHLLVDNAAMQIITRPKTFDVIVTENMFGDILSDEAAVITGSIGMLPSASLGDAGPGLYEPVHGSAPDIAGQGLANPLATFLSVALMMRHSLHLPEAADAIEQAVHGVIERGVRTRDLARSGEAFVKTADVSAMVCEDVKRRLG

SEQ ID NO: 232 - protein, 365 aa, Artificial
  Substituion in SEQ ID NO 222
MKGTDGMTKNIAILPGDGIGREVTAEAVKLIQVVAASRGETWNLEEGLIGGSALDATGSPLPEETVRLCRAADAVLLGAVGGPKWDHLPGDKRPEAGLLGIRKALEVYANLRPIRTWPGLLLASPLKPELVEGVDFIIVRELTGGLYFGQPKARLDGGEAVVDTLHYTRAEIRRVVKVAFELAKGRQGRLTSVDKANVLESSRVWREVVEEVASEYPGVLVEHLLVDNAAMQIITRPKTFDVIVTENMFGDILSDEAAVITGSIGMLPSASLGEAGPGLYEPVHGSAPDIAGQGLANPLATFLSVALMMRHSLHLPEAADAIEQAVHGVIEKGVRTRDLARSGEAFVKTADVSAMVCEDVKRRLG

SEQ ID NO: 233 - protein, 365 aa, Artificial
  Substituion in SEQ ID NO 222
MKGTDGMTKNIAILPGDGIGREVTAEAVKLIQVVAASRGETWNLEEGLIGGSALDATGSPLPEETVRLCRAADAVLLGAVGGPKWDHLPGDKRPEAGLLGIRKALEVYANLRPIRTWPGLLLASPLKPELVEGVDFIIVRELTGGLYFGQPKARLDGGEAVVDTLHYTRAEIRRVVKVAFELAKGRQGRLTSVDKANVLESSRVWREVVEEVASEYPGVLVDHLLVDNAAMQIITRPKTFDVIVTENMFGDILSDEAAVITGSIGMLPSASLGEAGPGLYEPVHGSAPDIAGQGLANPLATFLSVALMMRHSLHLPEAADAIEQAVHGVIERGVRTRDLARSGEAFVKTADVSAMVCEDVKRRLG

SEQ ID NO: 234 - DNA, 1098 bp, Artificial
  Substituion in SEQ ID NO 223
ttgaaagggacggatggcatgacaaagaacattgcgatcttgccgggagacggcatcggccgagaagtcacggcggaggcggtcaagctgatccaggtcgtcgccgcgagtcggggggagacgtggaacctcgaggaaggtctcattggcggcagcgcgctggacgcgacaggctcgccattgccggaagagacggtgaaactctgccgcgctgcggacgccgtgctgctcggcgcggtgggcggaccgaagtgggaccatctccccggcgacaagcgccctgaggcaggactgctcggcattcgcaaggcgcttgaggtctacgcgaatcttcggcccatccggacctggccagggctgttgctggcctcgccgctcaagccggagcttgtcgagggcgtggatttcatcatcgtgcgggagttgacgggtgggctttatttcggccagccgaaggcgcgcctcgatggcggcgaggcggtggtggacacgcttcattacacgcgcgccgagattcgccgcgtggtgaaggtggcctttgaactcgcgaaaggccggcaggggcgcctgacgtcggtcgacaaggcgaatgtgctcgagtcgagccgcgtgtggcgcgaggtggtggaggaggttgcgtccgaatatcccggcgttttggtggagcatctgctggtggacaacgccgccatgcagatcatcacgcggccgaagacgttcgacgtgatcgtgacggagaacatgtttggcgacattttgagcgacgaggcggccgtcatcacgggatccatcggcatgctgccttccgcgagcctcggcgaggcaggaccgggcctgtacgagcccgtgcacggctccgcgccggacatcgccggacagggcctcgccaatccgctggcgacgtttctgtccgtggcgctcatgatgcggcattccctgcacctccccgaggctgcggacgccatcgagcaggcggtgcacggcgtgattgagcggggcgtccgcacgcgcgatctcgcccgaagcggcgaggcgttcgtcaagacggcggacgtcagcgccatggtttgcgaagacgtgaaaaggaggctcggttga

SEQ ID NO: 235 - DNA, 1098 bp, Artificial
  Substituion in SEQ ID NO 223
ttgaaagggacggatggcatgacaaagaacattgcgatcttgccgggagacggcatcggccgagaagtcacggcggaggcggtcaagctgatccaggtcgtcgccgcgagtcggggggagacgtggaacctcgaggaaggtctcattggcggcagcgcgctggacgcgacaggctcgccattgccggaagagacggtgcggctctgccgcgctgcggacgccgtgctgctcggcgcggtgggcggaccgaagtgggaccatctccccggcgacaagcgccctgaggcaggactgctcggcattcgcaaggcgcttgaggtctacgcgaatcttcggcccatccggacctggccagggctgttgctggcctcgccgctcaagccggagcttgtcgagggcgtggatttcatcatcgtgcgggagttgacgggtgggctttatttcggccagccgaaggcgcgcctcgatggcggcgaggcggtggtggacacgcttcattacacgcgcgccgagattcgccgcgtggtgaaggtggcctttgaactcgcgaaaggccggcaggggcgcctgacgtcggtcgacaaggcgaatgtgctcgagtcgagccgcgtgtggcgcgaggtggtggaggaggttgcgtccgaatatcccggcgttttggtggagcatctgctggtggacaacgccgccatgcagatcatcacgcggccgaagacgttcgacgtgatcgtgacggagaacatgtttggcgacattttgagcgacgaggcggccgtcatcacgggatccatcggcatgctgccttccgcgagcctcggcgaggcaggaccgggcctgtacgagcccgtgcacggctccgcgccggacatcgccggacagggcctcgccaatccgctggcgacgtttctgtccgtggcgctcatgatgcggcattccctgcacctccccgaggctgcggacgccatcgagcaggcggtgcacggcgtgattgagcggggcgtccgcacgcgcgatctcgcccgaagcggcgaggcgttcgtcaagacggcggacgtcagcgccatggtttgcgaagacgtgaaaaggaggattggttga

SEQ ID NO: 236 - DNA, 1098 bp, Artificial
  Substituion in SEQ ID NO 223
ttgaaagggacggatggcatgacaaagaacattgcgatcttgccgggagacggcatcggccgagaagtcacggcggaggcggtcaagctgatccaggtcgtcgccgcgagtcggggggagacgtggaacctcgaggaaggtctcattggcggcagcgcgctggacgcgacaggctcgccattgccggaagagacggtgcggctctgccgcgctgcggacgccgtgctgctcggcgcggtgggcggaccgaagtgggaccatctccccggcgacaagcgccctgaggcaggactgctcggcattcgcaaggcgcttgaggtctacgcgaatcttcggcccatccggacctggccagggctgttgctggcctcgccgctcaagccggagcttgtcgagggcgtggatttcatcatcgtgcgggagttgacgggtgggctttatttcggccagccgaaggcgcgcctcgatggcggcgaggcggtggtggacacgcttcattacacgcgcgccgagattcgccgcgtggtgaaggtggcctttgaactcgcgaaaggccggcaggggcgcctgacgtcggtcgacaaggcgaatgtgctcgagtcgagccgcgtgtggcgcgaggtggtggaggaggttgcgtccgaatatcccggcgttttggtggagcatctgctggtggacaacgccgccatgcagatcatcacgcggccgaagacgttcgacgtgatcgtgacggagaacatgtttggcgacattttgagcgacgaggcggccgtcatcacgggatccatcggcatgctgccttccgcgagcctcggcgatgcaggaccgggcctgtacgagcccgtgcacggctccgcgccggacatcgccggacagggcctcgccaatccgctggcgacgtttctgtccgtggcgctcatgatgcggcattccctgcacctccccgaggctgcggacgccatcgagcaggcggtgcacggcgtgattgagcggggcgtccgcacgcgcgatctcgcccgaagcggcgaggcgttcgtcaagacggcggacgtcagcgccatggtttgcgaagacgtgaaaaggaggctcggttga

SEQ ID NO: 237 - DNA, 1098 bp, Artificial
  Substituion in SEQ ID NO 223
ttgaaagggacggatggcatgacaaagaacattgcgatcttgccgggagacggcatcggccgagaagtcacggcggaggcggtcaagctgatccaggtcgtcgccgcgagtcggggggagacgtggaacctcgaggaaggtctcattggcggcagcgcgctggacgcgacaggctcgccattgccggaagagacggtgcggctctgccgcgctgcggacgccgtgctgctcggcgcggtgggcggaccgaagtgggaccatctccccggcgacaagcgccctgaggcaggactgctcggcattcgcaaggcgcttgaggtctacgcgaatcttcggcccatccggacctggccagggctgttgctggcctcgccgctcaagccggagcttgtcgagggcgtggatttcatcatcgtgcgggagttgacgggtgggctttatttcggccagccgaaggcgcgcctcgatggcggcgaggcggtggtggacacgcttcattacacgcgcgccgagattcgccgcgtggtgaaggtggcctttgaactcgcgaaaggccggcaggggcgcctgacgtcggtcgacaaggcgaatgtgctcgagtcgagccgcgtgtggcgcgaggtggtggaggaggttgcgtccgaatatcccggcgttttggtggagcatctgctggtggacaacgccgccatgcagatcatcacgcggccgaagacgttcgacgtgatcgtgacggagaacatgtttggcgacattttgagcgacgaggcggccgtcatcacgggatccatcggcatgctgccttccgcgagcctcggcgaggcaggaccgggcctgtacgagcccgtgcacggctccgcgccggacatcgccggacagggcctcgccaatccgctggcgacgtttctgtccgtggcgctcatgatgcggcattccctgcacctccccgaggctgcggacgccatcgagcaggcggtgcacggcgtgattgagaaaggcgtccgcacgcgcgatctcgcccgaagcggcgaggcgttcgtcaagacggcggacgtcagcgccatggtttgcgaagacgtgaaaaggaggctcggttga

SEQ ID NO: 238 - DNA, 1098 bp, Artificial
  Substituion in SEQ ID NO 223
ttgaaagggacggatggcatgacaaagaacattgcgatcttgccgggagacggcatcggccgagaagtcacggcggaggcggtcaagctgatccaggtcgtcgccgcgagtcggggggagacgtggaacctcgaggaaggtctcattggcggcagcgcgctggacgcgacaggctcgccattgccggaagagacggtgcggctctgccgcgctgcggacgccgtgctgctcggcgcggtgggcggaccgaagtgggaccatctccccggcgacaagcgccctgaggcaggactgctcggcattcgcaaggcgcttgaggtctacgcgaatcttcggcccatccggacctggccagggctgttgctggcctcgccgctcaagccggagcttgtcgagggcgtggatttcatcatcgtgcgggagttgacgggtgggctttatttcggccagccgaaggcgcgcctcgatggcggcgaggcggtggtggacacgcttcattacacgcgcgccgagattcgccgcgtggtgaaggtggcctttgaactcgcgaaaggccggcaggggcgcctgacgtcggtcgacaaggcgaatgtgctcgagtcgagccgcgtgtggcgcgaggtggtggaggaggttgcgtccgaatatcccggcgttttggtggatcatctgctggtggacaacgccgccatgcagatcatcacgcggccgaagacgttcgacgtgatcgtgacggagaacatgtttggcgacattttgagcgacgaggcggccgtcatcacgggatccatcggcatgctgccttccgcgagcctcggcgaggcaggaccgggcctgtacgagcccgtgcacggctccgcgccggacatcgccggacagggcctcgccaatccgctggcgacgtttctgtccgtggcgctcatgatgcggcattccctgcacctccccgaggctgcggacgccatcgagcaggcggtgcacggcgtgattgagcggggcgtccgcacgcgcgatctcgcccgaagcggcgaggcgttcgtcaagacggcggacgtcagcgccatggtttgcgaagacgtgaaaaggaggctcggttga

SEQ ID NO: 239 - protein, 481 aa, Alicyclobacillus acidocaldarius
MRRREKEARLMGRTLFEKVWDAHVVKELPDGQTLLYIDLHLVHEVTSPQAFAGLRFAGRKVRRPELTFATMDHNVPTVNPKDVRDAIARKQIETLEQNCREFGVQLAGLDSPFQGIVHVIGPELGLTMPGKTIVCGDSHTSTHGAFGALAFGIGTSEVEHVLATQCLWQSRPKTMRIQLNGTLQPGVTAKDVILGLIAKYGVNFGTGHVVEYAGSLIPELSMEQRMTICNMSIEFGARAGMMAPDETTIAYVQGRRYAPKGADWEACVAAWRELKSDPDAVFDVDVVFDVNDLEPQVTWGTNPGQGTGISGVVPDPKDAKSEEEALAIRQALEYMDLKPGTKISEIPIQHVFIGSCTNARIEDLRLAASIVKGRRVADGVRAVVVPGSKQVKQQAEAEGLHEIFLEAGFEWREPGCSACLGMNPDIIPAGERCASTSNRNFEGRQGKGARTHLVSPAMAAAAAIAGHFVDVRELTSEGVTA

SEQ ID NO: 240 - DNA, 1446 bp, Alicyclobacillus acidocaldarius
ttgcgaagacgtgaaaaggaggctcggttgatggggaggaccctgttcgaaaaagtctgggacgcgcacgtggtcaaggaactgccggatggacagacgcttctctacattgacttgcacctcgtccacgaggtgacgtcgcctcaggcgtttgccggacttcgtttcgcggggcgcaaggttcgccggcccgagctgacgtttgcgaccatggatcacaacgtgccgacggtcaatccgaaggatgtccgggacgccattgcgcgcaagcagatcgagacgctggagcagaactgccgcgagttcggcgtccaactggcggggctcgacagccccttccagggcattgtgcatgtcatcggcccggagcttgggctgaccatgccggggaagacgattgtctgcggcgacagccacacgtcgacgcacggcgcgttcggcgcgctcgcctttggcatcggcacgagcgaggtggaacacgttctcgccacgcagtgcctctggcagagccgaccgaagaccatgcgcattcagctgaatggcacgcttcaaccgggcgtcaccgccaaggacgtgatcttgggcctgattgcgaaatacggcgtgaattttggcacgggccacgtcgtggagtacgcgggcagcctgatcccagagctcagcatggagcagcggatgaccatctgcaacatgtccatcgagttcggcgcccgggcgggcatgatggcgccggacgagacgaccatcgcctacgtccagggccggcgctatgcgccgaagggcgcggattgggaggcgtgcgtcgccgcatggcgcgaactgaagtccgatcccgacgccgtcttcgacgtcgacgtggtcttcgatgtgaatgacctcgagccgcaggtgacgtggggcaccaatccggggcaggggaccggcatcagcggcgtcgtgccggatccgaaggacgcgaagtccgaggaggaggcgctggccattcgacaggcgcttgagtacatggacctgaagccgggaaccaaaatctccgagatccccatccagcacgtgttcatcggatcgtgcaccaacgcccgcatcgaggatctgcgcttggccgcgagcatcgtcaagggccggcgcgtcgcggatggcgtgcgcgcggtggtcgtgccgggatcgaaacaggtgaagcagcaggcggaggccgaggggcttcacgagatcttcctcgaagcgggcttcgagtggcgcgagcccggctgcagcgcgtgtctcggcatgaatcccgacatcatcccggctggggagcggtgcgcatcgacgtccaaccgcaacttcgaaggccggcagggcaaaggggcccgcacgcacctcgtcagcccggccatggcggccgccgcggccatcgcggggcacttcgtcgacgtgcgcgaactgacctcggaaggagtgacggcgtga

SEQ ID NO: 241 - protein, 468 aa, Bacillus halodurans C-125
KTIIEKIWDAHTVIGEEGKPSLLYIDLHMVHEVTSPQAFEGLRLAGRPVRRPDLTFATMDHNVPTVDRFNIQDQIARKQIETLEANCKEFGIEIAGLDSPNNGIVHVIGPELGLTQPGKTIVCGDSHTSTHGAFGALAFGIGTSEVEHVLATQTLWQSKPKTMEVRVTGELAPSVSAKDIILAVIAKYGVDFGTGHVIEFTGEAIRSLSMEERMTICNMSIEAGAKAGLISPDSVTFEYLRGRPNAPKGEAFDVAIQQWEALATDAGAVYDRVLTMNASEIEPMVTWGTNPAQGTGVSQVVPSPDDAKDENERRAIKQSLAYMGLEPGTPITEIAIQHVFIGSCTNSRLSDLRTAAELIKGRKVADGVRALVVPGSQQVKRAAEKEGLDEIFKEAGFEWRDSGCSMCLGMNPDTVPEGERCASTSNRNFEGRQGKGARTHLVSPQMAAAAAIAGHFVDVRTFQSEPQT

SEQ ID NO: 242 - protein, 467 aa, Geobacillus kaustophilus HTA426
KTIIDKIWENHVVYREEGKPDLLYIDLHLVHEVTSPQAFEGLRQKGRKVRRPDLTFATMDHNVPTVNRFVITDEVARNQIAALERNCREFGIPLADLHSEEQGIVHVIGPELGLTQPGKTIVCGDSHTSTHGAFGALAFGIGTSEVEHVLATQTLWQHKPKTLQICINGRLGKGVTAKDVILAIIGRYGVGVGTGYIIEFTGEAIRRMSMEERMTICNMSIEAGARAGLISPDETTFAYLRGRKYAPKGEEFDKAVERWRALASDEGAKYDKTIEIDASTIAPMVTWGTNPAMSTSVDGVVPHPEQFESKTEQNAVRRALEYMGLKPGTPITDIPVQHVFIGSCTNSRLSDLRAAASIVKGKKVAPGVRALVVPGSQQVKKQAEAEGLAQIFIDAGFEWRDSGCSACLGMNPDIIPEGEHCASTSNRNFEGRQGKGARTHLVSPVMAAAAAIYGHFVDVRQLEAEPV

SEQ ID NO: 243 - protein, 467 aa, Geobacillus thermodenitrificans NG80-2
KTIIEKIWENHVVYREEGKPDLLYIDLHLVHEVTSPQAFEGLRQNGRKVRRPDLTFATMDHNVPTVNRFVITDEVARNQIAALERNCREFGIPLADLHSEEQGIVHVIGPELGLTQPGKTIVCGDSHTSTHGAFGALAFGIGTSEVEHVLATQTLWQHKPKTLQIRINGQLGKGVTAKDVILAIIGRYGVGVGTGYIIEFTGEAIRRMSMEERMTICNMSIEAGARAGLISPDETTFAYLRGRKYAPKGEEFDQAVERWRALASDEGAEYDKTIEIDASTIAPMVTWGTNPSMSTSVDGTVPDPEQFESETERNAVRRALEYMGLKPGMSITEIPVQHVFIGSCTNSRISDLREAAKIVKGQKVAPGVRALVVPGSQQVKKQAEEEGLAQIFLDAGFEWRDAGCSACLGMNPDIIPEGEHCASTSNRNFEGRQGKGARTHLVSPAMAAAAAIYGRFVDVRQLEAEPV

SEQ ID NO: 244 - protein, 471 aa, Bacillus sp. NRRL B-14911
MGKSIVEKIWDRHIVHTETDKPDLLYIDLHLVHEVTSPQAFSGLRMKNRKVRRPDKTFATMDHNVPTINRGQIDDPVAKKQMTTLEKNCREFGVPLAGMDSPDQGIVHVIGPELGLTRPGMTIVCGDSHTSTHGAFGSLAFGIGTSEVEHVLATQTLWQSRPKTLKLQIDGRLESGVTAKDVILYIISRFGIGFGTGHVIEYCGEAVRSMSMEERMTICNMSIEGGARAGLVSPDETTFSYIKGRKYAPKDNEWDTSLAHWQALASDPDANYDKEITLDAGEIPPMVSWGTNPSMAAGVDERIPSEADCKTETERTSLERALRYMGLSEGQEISDISIQHVFIGSCTNSRIEDLRQAAEFAAGKKVHPGVRALVVPGSQAVKEQAEKEGLHHIFIESGFEWRESGCSMCLSMNNDIVPPGEHCASTSNRNFEGRQGSGARTHLVSPLMAAAAAVNGKFVDVRKTLMEESIT

SEQ ID NO: 245 - protein, 473 aa, Symbiobacterium thermophilum IAM 14863
MSGRTLLDKIWERHVVRREPGKPDLLYIDLHLVHEVTSPQAFEGLRMAGRRVRRPDLTIATMDHNVPTTDRSLPLTDEIAARQMAALERNCSEFGVRLFDLYSPFQGIVHVIGPELGLTQPGLTIVCGDSHTATHGAFGALAFGIGTSEVEHVLATQCLWQHKPKVMEIRVNGKLPPGTTAKDLILGIIGQIGTDGATGYVIEYTGEAIRSLSMEGRMTVCNMSIEAGARAGMIAPDETTFAYLKGRPHAPQGELWEAAVADWRTLASDPDAVYDRVVEFDAGQLAPVVSWGTNPGQVVPVTGRIPDPRDFADPAQRKAAEAALAYMDLEPGTPIQDIRIDRVFIGSCTNGRIEDLRAAAAVVKGRKVAPGVRAMVVPGSGQVKAQAEAEGLDQIFREAGFEWREAGCSMCLGMNPDILAPGERCASTSNRNFEGRQGKGGRTHLVSPAMAAAAAIAGHFVDVRELLAEGGAA

SEQ ID NO: 246 - protein, 481 aa, Artificial
  Substituion in SEQ ID NO 239
MRRREKEARLMGRTLFEKVWDAHVVKELPDGQTLLYIDLHLVHEVTSPQAFAGLRFAGRKVRRPELTFATMDHNVPTVNPKDVRDAIARKQIETLEQNCREFGVQLAGLDSPFQGIVHVIGPELGLTMPGKTIVCGDSHTSTHGAFGALAFGIGTSEVEHVLATQCLWQSRPKTMRIQLNGTLQPGVTAKDVILGLIAKYGVNFGTGHVVEYAGSLIPELSMEQRMTICNMSIEFGARAGMMAPDETTIAYVQGRRYAPKGADWEACVAAWRELKSDPDAVFDVDVVFDVNDLEPQVTWGTNPGQGTGISGVVPDPRDAKSEEEALAIRQALEYMDLKPGTKISEIPIQHVFIGSCTNARIEDLRLAASIVKGRRVADGVRAVVVPGSKQVKQQAEAEGLHEIFLEAGFEWREPGCSACLGMNPDIIPAGERCASTSNRNFEGRQGKGARTHLVSPAMAAAAAIAGHFVDVRELTSEGVTA

SEQ ID NO: 247 - protein, 481 aa, Artificial
  Substituion in SEQ ID NO 239
MRRREKEARLMGRTLFEKVWDAHIVKELPDGQTLLYIDLHLVHEVTSPQAFAGLRFAGRKVRRPELTFATMDHNVPTVNPKDVRDAIARKQIETLEQNCREFGVQLAGLDSPFQGIVHVIGPELGLTMPGKTIVCGDSHTSTHGAFGALAFGIGTSEVEHVLATQCLWQSRPKTMRIQLNGTLQPGVTAKDVILGLIAKYGVNFGTGHVVEYAGSLIPELSMEQRMTICNMSIEFGARAGMMAPDETTIAYVQGRRYAPKGADWEACVAAWRELKSDPDAVFDVDVVFDVNDLEPQVTWGTNPGQGTGISGVVPDPKDAKSEEEALAIRQALEYMDLKPGTKISEIPIQHVFIGSCTNARIEDLRLAASIVKGRRVADGVRAVVVPGSKQVKQQAEAEGLHEIFLEAGFEWREPGCSACLGMNPDIIPAGERCASTSNRNFEGRQGKGARTHLVSPAMAAAAAIAGHFVDVRELTSEGVTA

SEQ ID NO: 248 - protein, 481 aa, Artificial
  Substituion in SEQ ID NO 239
MRRREKEARLMGRTLFEKVWDAHVVKELPDGQTLLYIDLHLVHEVTSPQAFAGLRFAGRKVRRPELTFATMDHNVPTVNPKDVRDAIARKQIETLEQNCREFGVQLAGLDSPFQGIVHVIGPELGLTMPGKTIVCGDSHTSTHGAFGALAFGIGTSEVEHVLATQCLWQSRPKTMRIQLNGTLQPGVTAKDVILGLIAKYGVNFGTGHVVEYAGSLIPELSMEQRMTICNMSIEFGARAGMMAPDETTIAYVQGRRYAPKGADWEACVAAWRELKSDPDAVFDVDVVFDVNDLEPQVTWGTNPGQGTGISGVVPDPKDAKSEEEALAIRQALEYMDLKPGTKISEIPIQHVFIGSCTNARIEDLRLAASIVKGRRVADGVRAVVVPGSRQVKQQAEAEGLHEIFLEAGFEWREPGCSACLGMNPDIIPAGERCASTSNRNFEGRQGKGARTHLVSPAMAAAAAIAGHFVDVRELTSEGVTA

SEQ ID NO: 249 - protein, 481 aa, Artificial
  Substituion in SEQ ID NO 239
MRRREKEARLMGRTLFEKVWDAHVVRELPDGQTLLYIDLHLVHEVTSPQAFAGLRFAGRKVRRPELTFATMDHNVPTVNPKDVRDAIARKQIETLEQNCREFGVQLAGLDSPFQGIVHVIGPELGLTMPGKTIVCGDSHTSTHGAFGALAFGIGTSEVEHVLATQCLWQSRPKTMRIQLNGTLQPGVTAKDVILGLIAKYGVNFGTGHVVEYAGSLIPELSMEQRMTICNMSIEFGARAGMMAPDETTIAYVQGRRYAPKGADWEACVAAWRELKSDPDAVFDVDVVFDVNDLEPQVTWGTNPGQGTGISGVVPDPKDAKSEEEALAIRQALEYMDLKPGTKISEIPIQHVFIGSCTNARIEDLRLAASIVKGRRVADGVRAVVVPGSKQVKQQAEAEGLHEIFLEAGFEWREPGCSACLGMNPDIIPAGERCASTSNRNFEGRQGKGARTHLVSPAMAAAAAIAGHFVDVRELTSEGVTA

SEQ ID NO: 250 - protein, 481 aa, Artificial
  Substituion in SEQ ID NO 239
MRRREKEARLMGRTLFEKVWDAHVVKELPDGQTLLYIDLHLVHEVTSPQAFAGLRFAGRKVRRPELTFATMDHNVPTVNPKDVRDAIARKQIETLEQNCREFGVQLAGLDSPFQGIVHVIGPELGLTMPGKTIVCGDSHTSTHGAFGALAFGIGTSEVEHVLATQCLWQSRPKTMRIQLNGTLQPGVTAKDVILGLIAKYGVNFGTGHVVEYAGSLIPELSMEQRMTICNMSIEFGARAGMMAPDETTIAYVQGRRYAPKGADWEACVAAWRELKSDPDAVFDVDVVFDVNDLEPQVTWGTNPGQGTGISGVVPDPKDAKSDEEALAIRQALEYMDLKPGTKISEIPIQHVFIGSCTNARIEDLRLAASIVKGRRVADGVRAVVVPGSKQVKQQAEAEGLHEIFLEAGFEWREPGCSACLGMNPDIIPAGERCASTSNRNFEGRQGKGARTHLVSPAMAAAAAIAGHFVDVRELTSEGVTA

SEQ ID NO: 251 - DNA, 1446 bp, Artificial
  Substituion in SEQ ID NO 240
ttgcgaagacgtgaaaaggaggctcggttgatggggaggaccctgttcgaaaaagtctgggacgcgcacgtggtcaaggaactgccggatggacagacgcttctctacattgacttgcacctcgtccacgaggtgacgtcgcctcaggcgtttgccggacttcgtttcgcggggcgcaaggttcgccggcccgagctgacgtttgcgaccatggatcacaacgtgccgacggtcaatccgaaggatgtccgggacgccattgcgcgcaagcagatcgagacgctggagcagaactgccgcgagttcggcgtccaactggcggggctcgacagccccttccagggcattgtgcatgtcatcggcccggagcttgggctgaccatgccggggaagacgattgtctgcggcgacagccacacgtcgacgcacggcgcgttcggcgcgctcgcctttggcatcggcacgagcgaggtggaacacgttctcgccacgcagtgcctctggcagagccgaccgaagaccatgcgcattcagctgaatggcacgcttcaaccgggcgtcaccgccaaggacgtgatcttgggcctgattgcgaaatacggcgtgaattttggcacgggccacgtcgtggagtacgcgggcagcctgatcccagagctcagcatggagcagcggatgaccatctgcaacatgtccatcgagttcggcgcccgggcgggcatgatggcgccggacgagacgaccatcgcctacgtccagggccggcgctatgcgccgaagggcgcggattgggaggcgtgcgtcgccgcatggcgcgaactgaagtccgatcccgacgccgtcttcgacgtcgacgtggtcttcgatgtgaatgacctcgagccgcaggtgacgtggggcaccaatccggggcaggggaccggcatcagcggcgtcgtgccggatccgcgtgacgcgaagtccgaggaggaggcgctggccattcgacaggcgcttgagtacatggacctgaagccgggaaccaaaatctccgagatccccatccagcacgtgttcatcggatcgtgcaccaacgcccgcatcgaggatctgcgcttggccgcgagcatcgtcaagggccggcgcgtcgcggatggcgtgcgcgcggtggtcgtgccgggatcgaaacaggtgaagcagcaggcggaggccgaggggcttcacgagatcttcctcgaagcgggcttcgagtggcgcgagcccggctgcagcgcgtgtctcggcatgaatcccgacatcatcccggctggggagcggtgcgcatcgacgtccaaccgcaacttcgaaggccggcagggcaaaggggcccgcacgcacctcgtcagcccggccatggcggccgccgcggccatcgcggggcacttcgtcgacgtgcgcgaactgacctcggaaggagtgacggcgtga

SEQ ID NO: 252 - DNA, 1446 bp, Artificial
  Substituion in SEQ ID NO 240
ttgcgaagacgtgaaaaggaggctcggttgatggggaggaccctgttcgaaaaagtctgggacgcgcacattgtcaaggaactgccggatggacagacgcttctctacattgacttgcacctcgtccacgaggtgacgtcgcctcaggcgtttgccggacttcgtttcgcggggcgcaaggttcgccggcccgagctgacgtttgcgaccatggatcacaacgtgccgacggtcaatccgaaggatgtccgggacgccattgcgcgcaagcagatcgagacgctggagcagaactgccgcgagttcggcgtccaactggcggggctcgacagccccttccagggcattgtgcatgtcatcggcccggagcttgggctgaccatgccggggaagacgattgtctgcggcgacagccacacgtcgacgcacggcgcgttcggcgcgctcgcctttggcatcggcacgagcgaggtggaacacgttctcgccacgcagtgcctctggcagagccgaccgaagaccatgcgcattcagctgaatggcacgcttcaaccgggcgtcaccgccaaggacgtgatcttgggcctgattgcgaaatacggcgtgaattttggcacgggccacgtcgtggagtacgcgggcagcctgatcccagagctcagcatggagcagcggatgaccatctgcaacatgtccatcgagttcggcgcccgggcgggcatgatggcgccggacgagacgaccatcgcctacgtccagggccggcgctatgcgccgaagggcgcggattgggaggcgtgcgtcgccgcatggcgcgaactgaagtccgatcccgacgccgtcttcgacgtcgacgtggtcttcgatgtgaatgacctcgagccgcaggtgacgtggggcaccaatccggggcaggggaccggcatcagcggcgtcgtgccggatccgaaggacgcgaagtccgaggaggaggcgctggccattcgacaggcgcttgagtacatggacctgaagccgggaaccaaaatctccgagatccccatccagcacgtgttcatcggatcgtgcaccaacgcccgcatcgaggatctgcgcttggccgcgagcatcgtcaagggccggcgcgtcgcggatggcgtgcgcgcggtggtcgtgccgggatcgaaacaggtgaagcagcaggcggaggccgaggggcttcacgagatcttcctcgaagcgggcttcgagtggcgcgagcccggctgcagcgcgtgtctcggcatgaatcccgacatcatcccggctggggagcggtgcgcatcgacgtccaaccgcaacttcgaaggccggcagggcaaaggggcccgcacgcacctcgtcagcccggccatggcggccgccgcggccatcgcggggcacttcgtcgacgtgcgcgaactgacctcggaaggagtgacggcgtga

SEQ ID NO: 253 - DNA, 1446 bp, Artificial
  Substituion in SEQ ID NO 240
ttgcgaagacgtgaaaaggaggctcggttgatggggaggaccctgttcgaaaaagtctgggacgcgcacgtggtcaaggaactgccggatggacagacgcttctctacattgacttgcacctcgtccacgaggtgacgtcgcctcaggcgtttgccggacttcgtttcgcggggcgcaaggttcgccggcccgagctgacgtttgcgaccatggatcacaacgtgccgacggtcaatccgaaggatgtccgggacgccattgcgcgcaagcagatcgagacgctggagcagaactgccgcgagttcggcgtccaactggcggggctcgacagccccttccagggcattgtgcatgtcatcggcccggagcttgggctgaccatgccggggaagacgattgtctgcggcgacagccacacgtcgacgcacggcgcgttcggcgcgctcgcctttggcatcggcacgagcgaggtggaacacgttctcgccacgcagtgcctctggcagagccgaccgaagaccatgcgcattcagctgaatggcacgcttcaaccgggcgtcaccgccaaggacgtgatcttgggcctgattgcgaaatacggcgtgaattttggcacgggccacgtcgtggagtacgcgggcagcctgatcccagagctcagcatggagcagcggatgaccatctgcaacatgtccatcgagttcggcgcccgggcgggcatgatggcgccggacgagacgaccatcgcctacgtccagggccggcgctatgcgccgaagggcgcggattgggaggcgtgcgtcgccgcatggcgcgaactgaagtccgatcccgacgccgtcttcgacgtcgacgtggtcttcgatgtgaatgacctcgagccgcaggtgacgtggggcaccaatccggggcaggggaccggcatcagcggcgtcgtgccggatccgaaggacgcgaagtccgaggaggaggcgctggccattcgacaggcgcttgagtacatggacctgaagccgggaaccaaaatctccgagatccccatccagcacgtgttcatcggatcgtgcaccaacgcccgcatcgaggatctgcgcttggccgcgagcatcgtcaagggccggcgcgtcgcggatggcgtgcgcgcggtggtcgtgccgggatcgcgtcaggtgaagcagcaggcggaggccgaggggcttcacgagatcttcctcgaagcgggcttcgagtggcgcgagcccggctgcagcgcgtgtctcggcatgaatcccgacatcatcccggctggggagcggtgcgcatcgacgtccaaccgcaacttcgaaggccggcagggcaaaggggcccgcacgcacctcgtcagcccggccatggcggccgccgcggccatcgcggggcacttcgtcgacgtgcgcgaactgacctcggaaggagtgacggcgtga

SEQ ID NO: 254 - DNA, 1446 bp, Artificial
  Substituion in SEQ ID NO 240
ttgcgaagacgtgaaaaggaggctcggttgatggggaggaccctgttcgaaaaagtctgggacgcgcacgtggtccgtgaactgccggatggacagacgcttctctacattgacttgcacctcgtccacgaggtgacgtcgcctcaggcgtttgccggacttcgtttcgcggggcgcaaggttcgccggcccgagctgacgtttgcgaccatggatcacaacgtgccgacggtcaatccgaaggatgtccgggacgccattgcgcgcaagcagatcgagacgctggagcagaactgccgcgagttcggcgtccaactggcggggctcgacagccccttccagggcattgtgcatgtcatcggcccggagcttgggctgaccatgccggggaagacgattgtctgcggcgacagccacacgtcgacgcacggcgcgttcggcgcgctcgcctttggcatcggcacgagcgaggtggaacacgttctcgccacgcagtgcctctggcagagccgaccgaagaccatgcgcattcagctgaatggcacgcttcaaccgggcgtcaccgccaaggacgtgatcttgggcctgattgcgaaatacggcgtgaattttggcacgggccacgtcgtggagtacgcgggcagcctgatcccagagctcagcatggagcagcggatgaccatctgcaacatgtccatcgagttcggcgcccgggcgggcatgatggcgccggacgagacgaccatcgcctacgtccagggccggcgctatgcgccgaagggcgcggattgggaggcgtgcgtcgccgcatggcgcgaactgaagtccgatcccgacgccgtcttcgacgtcgacgtggtcttcgatgtgaatgacctcgagccgcaggtgacgtggggcaccaatccggggcaggggaccggcatcagcggcgtcgtgccggatccgaaggacgcgaagtccgaggaggaggcgctggccattcgacaggcgcttgagtacatggacctgaagccgggaaccaaaatctccgagatccccatccagcacgtgttcatcggatcgtgcaccaacgcccgcatcgaggatctgcgcttggccgcgagcatcgtcaagggccggcgcgtcgcggatggcgtgcgcgcggtggtcgtgccgggatcgaaacaggtgaagcagcaggcggaggccgaggggcttcacgagatcttcctcgaagcgggcttcgagtggcgcgagcccggctgcagcgcgtgtctcggcatgaatcccgacatcatcccggctggggagcggtgcgcatcgacgtccaaccgcaacttcgaaggccggcagggcaaaggggcccgcacgcacctcgtcagcccggccatggcggccgccgcggccatcgcggggcacttcgtcgacgtgcgcgaactgacctcggaaggagtgacggcgtga

SEQ ID NO: 255 - DNA, 1446 bp, Artificial
  Substituion in SEQ ID NO 240
ttgcgaagacgtgaaaaggaggctcggttgatggggaggaccctgttcgaaaaagtctgggacgcgcacgtggtcaaggaactgccggatggacagacgcttctctacattgacttgcacctcgtccacgaggtgacgtcgcctcaggcgtttgccggacttcgtttcgcggggcgcaaggttcgccggcccgagctgacgtttgcgaccatggatcacaacgtgccgacggtcaatccgaaggatgtccgggacgccattgcgcgcaagcagatcgagacgctggagcagaactgccgcgagttcggcgtccaactggcggggctcgacagccccttccagggcattgtgcatgtcatcggcccggagcttgggctgaccatgccggggaagacgattgtctgcggcgacagccacacgtcgacgcacggcgcgttcggcgcgctcgcctttggcatcggcacgagcgaggtggaacacgttctcgccacgcagtgcctctggcagagccgaccgaagaccatgcgcattcagctgaatggcacgcttcaaccgggcgtcaccgccaaggacgtgatcttgggcctgattgcgaaatacggcgtgaattttggcacgggccacgtcgtggagtacgcgggcagcctgatcccagagctcagcatggagcagcggatgaccatctgcaacatgtccatcgagttcggcgcccgggcgggcatgatggcgccggacgagacgaccatcgcctacgtccagggccggcgctatgcgccgaagggcgcggattgggaggcgtgcgtcgccgcatggcgcgaactgaagtccgatcccgacgccgtcttcgacgtcgacgtggtcttcgatgtgaatgacctcgagccgcaggtgacgtggggcaccaatccggggcaggggaccggcatcagcggcgtcgtgccggatccgaaggacgcgaagtccgatgaggaggcgctggccattcgacaggcgcttgagtacatggacctgaagccgggaaccaaaatctccgagatccccatccagcacgtgttcatcggatcgtgcaccaacgcccgcatcgaggatctgcgcttggccgcgagcatcgtcaagggccggcgcgtcgcggatggcgtgcgcgcggtggtcgtgccgggatcgaaacaggtgaagcagcaggcggaggccgaggggcttcacgagatcttcctcgaagcgggcttcgagtggcgcgagcccggctgcagcgcgtgtctcggcatgaatcccgacatcatcccggctggggagcggtgcgcatcgacgtccaaccgcaacttcgaaggccggcagggcaaaggggcccgcacgcacctcgtcagcccggccatggcggccgccgcggccatcgcggggcacttcgtcgacgtgcgcgaactgacctcggaaggagtgacggcgtga

SEQ ID NO: 256 - protein, 203 aa, Alicyclobacillus acidocaldarius
MMEPMVRHEGLVVCMNRVNVDTDQIIPKQFLKRIERDGFGEFLFFDWRYLPDGSPNPDFELNQPEAQGATILLVDDNFGCGSSREHAVWALRDYGFRVILAPSFADIFYNNCFKNGLLPIRIPRELYKQLSESHARGEWRRMTVDLEQQMAATDHGVTFSFEIDPHKRHMLLRGLDDIGITLQYEADIAAYEASRRPYQFVYA

SEQ ID NO: 257 - DNA, 612 bp, Alicyclobacillus acidocaldarius
gtgatggagcccatggtcaggcacgaaggcctcgtggtctgcatgaaccgcgtgaacgtggacacggatcaaatcatcccgaaacaatttctcaagcggatcgagcgcgatggattcggcgagttcctgttcttcgactggcggtacctgccggacggatcgcccaaccccgacttcgagctgaatcagccggaggcccaaggcgcgaccatcttgctcgtcgacgacaacttcggctgcggatcgtcccgcgaacacgcggtctgggcgcttcgcgactacgggtttcgggtcatcctcgccccgtcgttcgccgacatcttctacaacaactgcttcaaaaacggccttctgcccattcgcatcccgcgcgagctctacaagcaactctcggagtcgcacgcgcgcggcgaatggcggcgcatgacggtggatctcgagcagcagatggccgcgaccgatcacggcgtgaccttttccttcgagatcgatccgcacaagcggcacatgctgctccgtgggctcgacgacatcggcatcacgctccaatacgaggccgatatcgccgcgtacgaggcctcgcgccgcccgtatcagttcgtctacgcgtaa

SEQ ID NO: 258 - protein, 194 aa, 3-isopropylmalate dehydratase small subunit (Isopropylmalate isomerase) (Alpha-IPM isomerase) (IPMI) Score: 25 7 Significance: 3e-67 Identities: 128/196 Positives: 148/196 Gaps: 2/196
MRPFTRETGLAVPLDRVNVDTDQIIPKQFLKRIERTGFGQFLFHDWRYLPDGSPNPEFVLNRPQYAGATILIAGRNFGSGSSREHAPWALSDYGFRAIIAPSFADIFYNNCFQNGLLPVVLPEEAVAELMRRAQEPGYRLTVDLERCVVEDDAGFRVDFAIDAFRRHRMLHGLDDIGLTLQYEDEIAAYEARRP

SEQ ID NO: 259 - protein, 195 aa, Geobacillus kaustophilus HTA426
MKPFTIHRGKTAGIDRANIDTDQIIPKQFLKRIERTGFGQFLFYDWRYLSDGTPNPEFELNRPENEGATILVADENFGCGSSREHAPWALQDYGFRVIIAPSFADIFYNNCLKNGLLPIRLDKEDVRYLLRQSERADYELTVSLEEQRVFDDEGFSRPFDIDPYRKQLLLKGWDEIDLTFVYEAHIAAYERRHCP

SEQ ID NO: 260 - protein, 195 aa, Geobacillus thermodenitrificans NG80-2
MKPFTIHRGKTAGIDRVNIDTDQIIPKQFLKRIERTGFGQFLFYDWRYLSDGTPNPEFELNRPENEGATILVAGDNFGCGSSREHAPWALQDYGFRAIIAPSFADIFYNNCLKNGLLPIRLDQEDVRYLLQQSERADYELTVSLEEQRVFDDEGFSRPFDIDPYRKKLLLKGWDEIDLTFVYESHIAAYEQKHCP

SEQ ID NO: 261 - protein, 193 aa, Bacillus licheniformis ATCC 14580
MEPLKTHNGIAAVLNRINVDTDQIIPKQFLKRIERTGYGRFAFFDWRYLDNGDPNPDFELNRPEYKGASILIAGENFGCGSSREHAPWALDDYGFKIIIAPSFADIFHQNCFKNGMLPIRLPYEAWKELAEQYEYQSLTMTVDLEKQTITDHAGRQIAFEVDPHWKEMLLNGYDEISLTLLLEEEIEQFEKQR

SEQ ID NO: 262 - protein, 193 aa, Bacillus pumilus SAFR-032
MEPLVTHKGKAAVLNRINVDTDQIIPKQFLKRIERTGYGRFAFFDWRYLADGSPNPDFELNQPIYEGSSILIAGENFGCGSSREHAPWALDDYGFKIVIAPSFADIFHQNCFKNGMLPIRLDYDVWKTFAASYENKGYEMTVDLEKQQIEDHEGNITPFDVDPHWREMLLNGYDEISLTLLLEDDIQAFEDKR

SEQ ID NO: 263 - protein, 203 aa, Artificial
  Substituion in SEQ ID NO 256
MMEPMVRHEGLVVCMNRVNVDTDQIIPKQFLKRIERDGFGEFLFFDWRYLPDGSPNPDFELNQPEAQGATILLVDDNFGCGSSREHAVWALRDYGFRVILAPSFADIFYNNCFKNGLLPIRIPRELYKNLSESHARGEWRRMTVDLEQQMAATDHGVTFSFEIDPHKRHMLLRGLDDIGITLQYEADIAAYEASRRPYQFVYA

SEQ ID NO: 264 - protein, 203 aa, Artificial
  Substituion in SEQ ID NO 256
MMEPMVRHEGLVVCMNRVNVDTDQIIPKQFLKRIERDGFGEFIFFDWRYLPDGSPNPDFELNQPEAQGATILLVDDNFGCGSSREHAVWALRDYGFRVILAPSFADIFYNNCFKNGLLPIRIPRELYKQLSESHARGEWRRMTVDLEQQMAATDHGVTFSFEIDPHKRHMLLRGLDDIGITLQYEADIAAYEASRRPYQFVYA

SEQ ID NO: 265 - protein, 203 aa, Artificial
  Substituion in SEQ ID NO 256
MMEPMVRHEGLVVCMNRVNVDTDQIIPKQFLKRIERDGFGEFLFFDWRYLPDGSPNPDFELNQPEAQGATILLVDDNFGCGSSREHAVWALRDYGFRVILAPSFADIFYNNCFKNGLLPIRIPRELYKQLSESHARGEWRKMTVDLEQQMAATDHGVTFSFEIDPHKRHMLLRGLDDIGITLQYEADIAAYEASRRPYQFVYA

SEQ ID NO: 266 - protein, 203 aa, Artificial
  Substituion in SEQ ID NO 256
MMEPMVRHEGLVVCMNRVNVDTDQIIPKQFLKRIERDGFGEFLFFDWRYLPDGSPNPDFELNQPEANGATILLVDDNFGCGSSREHAVWALRDYGFRVILAPSFADIFYNNCFKNGLLPIRIPRELYKQLSESHARGEWRRMTVDLEQQMAATDHGVTFSFEIDPHKRHMLLRGLDDIGITLQYEADIAAYEASRRPYQFVYA

SEQ ID NO: 267 - protein, 203 aa, Artificial
  Substituion in SEQ ID NO 256
MMEPMVRHEGLVVCMNRVNVDTDQIIPKQFLKRIERDGFGEFLFFDWRYLPDGSPNPDFELNQPDAQGATILLVDDNFGCGSSREHAVWALRDYGFRVILAPSFADIFYNNCFKNGLLPIRIPRELYKQLSESHARGEWRRMTVDLEQQMAATDHGVTFSFEIDPHKRHMLLRGLDDIGITLQYEADIAAYEASRRPYQFVYA

SEQ ID NO: 268 - DNA, 612 bp, Artificial
  Substituion in SEQ ID NO 257
gtgatggagcccatggtcaggcacgaaggcctcgtggtctgcatgaaccgcgtgaacgtggacacggatcaaatcatcccgaaacaatttctcaagcggatcgagcgcgatggattcggcgagttcctgttcttcgactggcggtacctgccggacggatcgcccaaccccgacttcgagctgaatcagccggaggcccaaggcgcgaccatcttgctcgtcgacgacaacttcggctgcggatcgtcccgcgaacacgcggtctgggcgcttcgcgactacgggtttcgggtcatcctcgccccgtcgttcgccgacatcttctacaacaactgcttcaaaaacggccttctgcccattcgcatcccgcgcgagctctacaagaatctctcggagtcgcacgcgcgcggcgaatggcggcgcatgacggtggatctcgagcagcagatggccgcgaccgatcacggcgtgaccttttccttcgagatcgatccgcacaagcggcacatgctgctccgtgggctcgacgacatcggcatcacgctccaatacgaggccgatatcgccgcgtacgaggcctcgcgccgcccgtatcagttcgtctacgcgtaa

SEQ ID NO: 269 - DNA, 612 bp, Artificial
  Substituion in SEQ ID NO 257
gtgatggagcccatggtcaggcacgaaggcctcgtggtctgcatgaaccgcgtgaacgtggacacggatcaaatcatcccgaaacaatttctcaagcggatcgagcgcgatggattcggcgagttcattttcttcgactggcggtacctgccggacggatcgcccaaccccgacttcgagctgaatcagccggaggcccaaggcgcgaccatcttgctcgtcgacgacaacttcggctgcggatcgtcccgcgaacacgcggtctgggcgcttcgcgactacgggtttcgggtcatcctcgccccgtcgttcgccgacatcttctacaacaactgcttcaaaaacggccttctgcccattcgcatcccgcgcgagctctacaagcaactctcggagtcgcacgcgcgcggcgaatggcggcgcatgacggtggatctcgagcagcagatggccgcgaccgatcacggcgtgaccttttccttcgagatcgatccgcacaagcggcacatgctgctccgtgggctcgacgacatcggcatcacgctccaatacgaggccgatatcgccgcgtacgaggcctcgcgccgcccgtatcagttcgtctacgcgtaa

SEQ ID NO: 270 - DNA, 612 bp, Artificial
  Substituion in SEQ ID NO 257
gtgatggagcccatggtcaggcacgaaggcctcgtggtctgcatgaaccgcgtgaacgtggacacggatcaaatcatcccgaaacaatttctcaagcggatcgagcgcgatggattcggcgagttcctgttcttcgactggcggtacctgccggacggatcgcccaaccccgacttcgagctgaatcagccggaggcccaaggcgcgaccatcttgctcgtcgacgacaacttcggctgcggatcgtcccgcgaacacgcggtctgggcgcttcgcgactacgggtttcgggtcatcctcgccccgtcgttcgccgacatcttctacaacaactgcttcaaaaacggccttctgcccattcgcatcccgcgcgagctctacaagcaactctcggagtcgcacgcgcgcggcgaatggcggaaaatgacggtggatctcgagcagcagatggccgcgaccgatcacggcgtgaccttttccttcgagatcgatccgcacaagcggcacatgctgctccgtgggctcgacgacatcggcatcacgctccaatacgaggccgatatcgccgcgtacgaggcctcgcgccgcccgtatcagttcgtctacgcgtaa

SEQ ID NO: 271 - DNA, 612 bp, Artificial
  Substituion in SEQ ID NO 257
gtgatggagcccatggtcaggcacgaaggcctcgtggtctgcatgaaccgcgtgaacgtggacacggatcaaatcatcccgaaacaatttctcaagcggatcgagcgcgatggattcggcgagttcctgttcttcgactggcggtacctgccggacggatcgcccaaccccgacttcgagctgaatcagccggaggccaatggcgcgaccatcttgctcgtcgacgacaacttcggctgcggatcgtcccgcgaacacgcggtctgggcgcttcgcgactacgggtttcgggtcatcctcgccccgtcgttcgccgacatcttctacaacaactgcttcaaaaacggccttctgcccattcgcatcccgcgcgagctctacaagcaactctcggagtcgcacgcgcgcggcgaatggcggcgcatgacggtggatctcgagcagcagatggccgcgaccgatcacggcgtgaccttttccttcgagatcgatccgcacaagcggcacatgctgctccgtgggctcgacgacatcggcatcacgctccaatacgaggccgatatcgccgcgtacgaggcctcgcgccgcccgtatcagttcgtctacgcgtaa

SEQ ID NO: 272 - DNA, 612 bp, Artificial
  Substituion in SEQ ID NO 257
gtgatggagcccatggtcaggcacgaaggcctcgtggtctgcatgaaccgcgtgaacgtggacacggatcaaatcatcccgaaacaatttctcaagcggatcgagcgcgatggattcggcgagttcctgttcttcgactggcggtacctgccggacggatcgcccaaccccgacttcgagctgaatcagccggatgcccaaggcgcgaccatcttgctcgtcgacgacaacttcggctgcggatcgtcccgcgaacacgcggtctgggcgcttcgcgactacgggtttcgggtcatcctcgccccgtcgttcgccgacatcttctacaacaactgcttcaaaaacggccttctgcccattcgcatcccgcgcgagctctacaagcaactctcggagtcgcacgcgcgcggcgaatggcggcgcatgacggtggatctcgagcagcagatggccgcgaccgatcacggcgtgaccttttccttcgagatcgatccgcacaagcggcacatgctgctccgtgggctcgacgacatcggcatcacgctccaatacgaggccgatatcgccgcgtacgaggcctcgcgccgcccgtatcagttcgtctacgcgtaa

SEQ ID NO: 273 - protein, 377 aa, Alicyclobacillus acidocaldarius
MAAETTFKAGLEDVVSNTSEICFLDGKQGRLLYYGYDIHDLVDGGASFEEVVYLLWHGELPNQSELKAFTEELASERALAEPVLDLLKRLPKDANAMAVLRTAVSFLGLYDPDDGDESLEANYRKAARLVAKIPTIVTSYERIRQGLDPVQPDPSLSAAANFFYLLRGTKPSEFEEKAFNTALILHADHELNASTFSARVTAGTLSDMYSAITSAIGTLKGPLHGGANEQVMRMLLEIGDPSKAITWIDEALAQKKKIMGFGHRVYRTEDPRATHLRELSKQAGELKGETKWFEMSQAIEKHMLEVKGLHANVDFYSASLYYSLGIPTHLYTPIFACSRISGWTAHVLEQYKNNRLIRPRAEYVGPTDRKFVPLSER

SEQ ID NO: 274 - DNA, 1134 bp, Alicyclobacillus acidocaldarius
atggcagcggaaacgacattcaaagccgggctggaagacgtggtctccaacacgtctgaaatctgcttcttggatgggaaacagggtcgccttctgtactacggatatgatatccacgatctcgtcgatggcggcgcctcgtttgaggaggtcgtgtaccttctgtggcacggcgagctgccgaatcagtcggagctgaaagcgttcaccgaggaactcgccagcgagcgggcattggctgaacccgtgctcgatctcttgaaacgcctcccgaaggacgcgaatgcgatggccgtacttcgcacggcggtctccttcctcggtctgtatgatcccgatgacggcgatgagagcctggaggcaaactaccgcaaagccgcgcgcctcgtcgcgaagattccaaccatcgtgacctcctacgagcgcatccgccaaggactggaccccgtacaaccggatccttcgctgagcgccgctgcgaacttcttctatctcctccgtggcacgaagccttccgaattcgaggagaaggcattcaacaccgcactcattctgcacgcagatcacgaattgaacgcttcgacgttctcggcgcgcgtcacggcgggcacgctgtcggacatgtattccgccatcacgtcggccatcggcacgcttaaaggtcctctgcacggcggcgccaatgagcaggtgatgcgcatgctgctcgaaattggcgatcccagcaaggccatcacgtggatcgacgaggcgctcgcgcagaagaagaagatcatgggcttcggccatcgcgtgtatcggaccgaggatccgcgcgcgacgcaccttcgcgagctcagcaagcaggcgggcgagctgaagggcgaaacgaaatggttcgagatgtcccaggccattgaaaagcacatgctcgaggtcaagggcctgcacgcgaacgtggacttctattcggcgtcgctctactattcgctcggcattccgacgcacctgtacacgcccatcttcgcgtgcagccgcatctccgggtggacggcgcacgtgctcgagcagtacaagaacaatcgcctcatccgcccgcgggccgagtacgtcggaccgacggatcgcaagtttgtcccgctcagcgagcgctga

SEQ ID NO: 275 - protein, 371 aa, Solibacter usitatus Ellin6076
TTTAGLEGIIAGESEICYIDGYLGILSYRGFNIHTLADNAKFEEVIFLLWNGWLPRQAELDALKAALVAERELPGAIVDFLKSAPKVNTMDLLRTAVSMLSLHDAEAQDMSAEANHRKAIRLMSKTATLVTTYDRLRNGKEVIPGDPKLSFAANFLYTLTGNRPDEIMERAFDVAMTLHADHELNASTFAARVVAATLSDIYSAITAGIGALKGPLHGGANQDVIKWLLSLGDEEEAVKAVENTLARKVKIPGFGHRVYRTDDPRATHLRVLSEELGKRTGHEKLYRLSQRMEATVKGIKGLNPNVDFYSASAYYSLGIPIDLYTPIFAVSRMSGWTAHVLEQYRNNRLIRPRAEYKGNPDGQTWIPIDKR

SEQ ID NO: 276 - protein, 370 aa, Candidatus Chloracidobacterium thermophilum
FVKGLEGVLAAQSSICFIDGAAGRLTYRGIDIHVLAEHSTFEETAYFLLFGHLPKQAELDAFTKQLQAEREVPTEIYTLLRTLPPTATPMEVLRTATSALSAYDPDGPDNSDEANVRKGIRLIARMTTLTTAYDRIRRGLEPVKPDPSLSMAESFLYGLTGEKPHPSSARVFDVCLILHADHELNASTFAARVIASTLSDMYAAITGAIGALAGSLHGGANQRVLEMLLEIGELDKVEAYVDNLFANKKKIMGFGHRVYRTMDPRATVLRKFAKQLGEDVGNTKWYEMAERIEQLAFARKKLYPNVDFFSAPVFYTLNIPVDLFTPIFACSRISGWVAHTLEQLRDNRLIRPLALYTGPEQAEYIPISER

SEQ ID NO: 277 - protein, 370 aa, Bacillus methanolicus
TVTRGLEGVVATTSSISSIIDDTLTYVGYNIDDLADNASFEEVIFLLWHRKLPTKSELEELKILLAENAELPKEILDHFKMYPIDKVHPMAALRSAVSLLGLYDEEADLMDEEANYRKAIRLQAKIPSIVAAFARVRKGLEPVAPRKDLSFAANFLYMLKGKEPEDIAVEAFNKVLVLHADHELNASTFTARVCVATLSDIYSGVTAAIGALKGPLHGGANEAVMKMLTEIGSLENVEPYIREKLAKKEKIMGFGHRVYRKGDPRAKHLREMSKKLTELTGEPHWYEMSTKIEAIVTGEKGLPPNVDFYSASIYHSLGIDHDLFTPIFAVSRISGWLAHILEQYENNRLIRPRADYIGPGMQKFIPIEQR

SEQ ID NO: 278 - protein, 370 aa, Bacillus sp. SG-1
TATRGLEGVVATTSSISSIIDDTLTYVGYNIDDLTNNASFEEIIYLLWNLKLPTASELDALKKDLAENAALPKEVIEHFKMYPIKDVHPMAALRSAVSLLGLYDEEADVMEEGANFRKAVRLQAKIPTIVTSFARIRSGKEPIAPRTDLGFAANFLYMLTGNEPADIEVEAFNKALVLHADHELNASTFTARVCVATLSDVYSGVTAAIGALKGPLHGGANEQVMKMLTEIDSVDNVESVIREKLANKEKIMGFGHRVYQQGDPRAKHLKEMSKKLTELRGESKYYEMSTKIEEIVTSEKGLPPNVDFYSASVYHSLGIDHDLFTPIFAVSRVSGWLAHILEQYSNNRLIRPRADYIGPGKQAYVPVEQR

SEQ ID NO: 279 - protein, 366 aa, Bacillus halodurans C-125
GLEGVVATTSSVSSIIESVLTYQGYDIDELAEHASFEEVIYLLWNGKLPNKVELKELADELANNAEIPQEVIEQMKAYPLDRVHPMGALRTAISSLGLYDEEADLMDEAANKRKALKLQAQVSTVVTAFSRIREGKEPVAPRTDLSFAANFLYMLTGEEPDEIAVDAFNKALVLHADHELNASTFTARVCVATLSDVYSGITAAIGALKGPLHGGANEQVMAMLTEIGDVENVEPYIRKALDNKQKIMGFGHRVYKNGDPRAKHLREMSKKLTSITGESKWYEMSVKIEEIVTNEKGLLPNVDFYSASVYHSLGIKHDLFTPIFAVSRMSGWLAHILEQYSNNRLIRPRAEYVGPNKRQYVRLEER

SEQ ID NO: 280 - protein, 377 aa, Artificial
  Substituion in SEQ ID NO 273
MAAETTFKAGLEDVVSNTSEICFLDGKQGRLLYYGYDIHDLVDGGASFEEVVYLLWHGELPNQSELKAFTEELASERALAEPVLDLLKRLPKDANAMAVLRTAVSFLGLYDPDDGDESLEANYRKAARLVAKIPTIVTSYERIRQGLDPVQPDPSLSAAANFFYLLRGTKPSEFEEKAFNTALILHADHELNASTFSARVTAGTLSDMYSAITSAIGTLKGPLHGGANEQVMRMLLEIGDPSKAITWIDEALAQKKKIMGFGHRVYRTEDPRATHLRELSKQAGELKGETKWFEMSQAIEKHMLEVKGLHANVDFYSASLYYSLGIPTHLYTPIFACSRISGWTAHVLEQYKNNRLIRPRADYVGPTDRKFVPLSER

SEQ ID NO: 281 - protein, 377 aa, Artificial
  Substituion in SEQ ID NO 273
MAAETTFKAGLEDVVSNTSEICFLDGKQGRLLYYGYDIHDLVDGGASFEEVVYLLWHGELPNQSELKAFTEELASERALAEPVLDLLKRLPKDANAMAVLRTAVSFLGLYDPDDGDESLEANYRKAARLVAKIPTIVTSYERIRQGLDPVQPDPSLSAAANFFYLLRGTKPSEFEEKAFNTALILHADHELNASTFSARVTAGTLSDMYSAITSAIGTLKGPLHGGANEQVMRMLLEIGDPSKAITWIDEALAQKKKIMGFGHRVYRTEDPRATHLRELSKQAGELKGETKWFEMSQAIEKHMLEVKGLHANVDFYSASLYYSLGIPTHLYTPIFACSRISGWTAHVLEQYKNNRLIRPRAEYVGPTDRRFVPLSER

SEQ ID NO: 282 - protein, 377 aa, Artificial
  Substituion in SEQ ID NO 273
MAAETTFKAGLEDVVSNTSEICFLDGKQGRLLYYGYDIHDLVDGGASFEEVVYLLWHGELPNQSELKAFTEELASERALAEPVLDLLKRLPKDANAMAVLRTAVSFLGLYDPDDGDESLEANYRKAARLVAKIPTIVTSYERIRQGLDPVQPDPSLSAAANFFYLLRGTKPSEFEEKAFNTALILHADHELNASTFSARVTAGTLSDMYSAITSAIGTLKGPLHGGANEQVMRMLLEIGDPSKAITWIDEALAQKKKIMGFGHRVYRTEDPRATHLRELSKQAGELKGETKWFEMSQAIEKHMLEVKGLHANVDFYSASLYYSLGIPTHLYTPIFACSRISGWTAHVLEQYKNNRLIRPRAEYVGPTDKKFVPLSER

SEQ ID NO: 283 - protein, 377 aa, Artificial
  Substituion in SEQ ID NO 273
MAAETTFKAGLEDVVSNTSEICFLDGKQGKLLYYGYDIHDLVDGGASFEEVVYLLWHGELPNQSELKAFTEELASERALAEPVLDLLKRLPKDANAMAVLRTAVSFLGLYDPDDGDESLEANYRKAARLVAKIPTIVTSYERIRQGLDPVQPDPSLSAAANFFYLLRGTKPSEFEEKAFNTALILHADHELNASTFSARVTAGTLSDMYSAITSAIGTLKGPLHGGANEQVMRMLLEIGDPSKAITWIDEALAQKKKIMGFGHRVYRTEDPRATHLRELSKQAGELKGETKWFEMSQAIEKHMLEVKGLHANVDFYSASLYYSLGIPTHLYTPIFACSRISGWTAHVLEQYKNNRLIRPRAEYVGPTDRKFVPLSER

SEQ ID NO: 284 - protein, 377 aa, Artificial
  Substituion in SEQ ID NO 273
MAAETTFKAGLEDVVSNTSEICFLDGKQGRLLYYGYDIHDLVDGGASFEEVVYLLWHGELPNQSELKAFTEELASERALAEPVLDLLKRLPKDANAMAVLRTAVSFLGLYDPDDGDESLEANYRKAARLVAKIPTIVTSYERIRNGLDPVQPDPSLSAAANFFYLLRGTKPSEFEEKAFNTALILHADHELNASTFSARVTAGTLSDMYSAITSAIGTLKGPLHGGANEQVMRMLLEIGDPSKAITWIDEALAQKKKIMGFGHRVYRTEDPRATHLRELSKQAGELKGETKWFEMSQAIEKHMLEVKGLHANVDFYSASLYYSLGIPTHLYTPIFACSRISGWTAHVLEQYKNNRLIRPRAEYVGPTDRKFVPLSER

SEQ ID NO: 285 - DNA, 1134 bp, Artificial
  Substituion in SEQ ID NO 274
atggcagcggaaacgacattcaaagccgggctggaagacgtggtctccaacacgtctgaaatctgcttcttggatgggaaacagggtcgccttctgtactacggatatgatatccacgatctcgtcgatggcggcgcctcgtttgaggaggtcgtgtaccttctgtggcacggcgagctgccgaatcagtcggagctgaaagcgttcaccgaggaactcgccagcgagcgggcattggctgaacccgtgctcgatctcttgaaacgcctcccgaaggacgcgaatgcgatggccgtacttcgcacggcggtctccttcctcggtctgtatgatcccgatgacggcgatgagagcctggaggcaaactaccgcaaagccgcgcgcctcgtcgcgaagattccaaccatcgtgacctcctacgagcgcatccgccaaggactggaccccgtacaaccggatccttcgctgagcgccgctgcgaacttcttctatctcctccgtggcacgaagccttccgaattcgaggagaaggcattcaacaccgcactcattctgcacgcagatcacgaattgaacgcttcgacgttctcggcgcgcgtcacggcgggcacgctgtcggacatgtattccgccatcacgtcggccatcggcacgcttaaaggtcctctgcacggcggcgccaatgagcaggtgatgcgcatgctgctcgaaattggcgatcccagcaaggccatcacgtggatcgacgaggcgctcgcgcagaagaagaagatcatgggcttcggccatcgcgtgtatcggaccgaggatccgcgcgcgacgcaccttcgcgagctcagcaagcaggcgggcgagctgaagggcgaaacgaaatggttcgagatgtcccaggccattgaaaagcacatgctcgaggtcaagggcctgcacgcgaacgtggacttctattcggcgtcgctctactattcgctcggcattccgacgcacctgtacacgcccatcttcgcgtgcagccgcatctccgggtggacggcgcacgtgctcgagcagtacaagaacaatcgcctcatccgcccgcgggccgattacgtcggaccgacggatcgcaagtttgtcccgctcagcgagcgctga

SEQ ID NO: 286 - DNA, 1134 bp, Artificial
  Substituion in SEQ ID NO 274
atggcagcggaaacgacattcaaagccgggctggaagacgtggtctccaacacgtctgaaatctgcttcttggatgggaaacagggtcgccttctgtactacggatatgatatccacgatctcgtcgatggcggcgcctcgtttgaggaggtcgtgtaccttctgtggcacggcgagctgccgaatcagtcggagctgaaagcgttcaccgaggaactcgccagcgagcgggcattggctgaacccgtgctcgatctcttgaaacgcctcccgaaggacgcgaatgcgatggccgtacttcgcacggcggtctccttcctcggtctgtatgatcccgatgacggcgatgagagcctggaggcaaactaccgcaaagccgcgcgcctcgtcgcgaagattccaaccatcgtgacctcctacgagcgcatccgccaaggactggaccccgtacaaccggatccttcgctgagcgccgctgcgaacttcttctatctcctccgtggcacgaagccttccgaattcgaggagaaggcattcaacaccgcactcattctgcacgcagatcacgaattgaacgcttcgacgttctcggcgcgcgtcacggcgggcacgctgtcggacatgtattccgccatcacgtcggccatcggcacgcttaaaggtcctctgcacggcggcgccaatgagcaggtgatgcgcatgctgctcgaaattggcgatcccagcaaggccatcacgtggatcgacgaggcgctcgcgcagaagaagaagatcatgggcttcggccatcgcgtgtatcggaccgaggatccgcgcgcgacgcaccttcgcgagctcagcaagcaggcgggcgagctgaagggcgaaacgaaatggttcgagatgtcccaggccattgaaaagcacatgctcgaggtcaagggcctgcacgcgaacgtggacttctattcggcgtcgctctactattcgctcggcattccgacgcacctgtacacgcccatcttcgcgtgcagccgcatctccgggtggacggcgcacgtgctcgagcagtacaagaacaatcgcctcatccgcccgcgggccgagtacgtcggaccgacggatcgccgttttgtcccgctcagcgagcgctga

SEQ ID NO: 287 - DNA, 1134 bp, Artificial
  Substituion in SEQ ID NO 274
atggcagcggaaacgacattcaaagccgggctggaagacgtggtctccaacacgtctgaaatctgcttcttggatgggaaacagggtcgccttctgtactacggatatgatatccacgatctcgtcgatggcggcgcctcgtttgaggaggtcgtgtaccttctgtggcacggcgagctgccgaatcagtcggagctgaaagcgttcaccgaggaactcgccagcgagcgggcattggctgaacccgtgctcgatctcttgaaacgcctcccgaaggacgcgaatgcgatggccgtacttcgcacggcggtctccttcctcggtctgtatgatcccgatgacggcgatgagagcctggaggcaaactaccgcaaagccgcgcgcctcgtcgcgaagattccaaccatcgtgacctcctacgagcgcatccgccaaggactggaccccgtacaaccggatccttcgctgagcgccgctgcgaacttcttctatctcctccgtggcacgaagccttccgaattcgaggagaaggcattcaacaccgcactcattctgcacgcagatcacgaattgaacgcttcgacgttctcggcgcgcgtcacggcgggcacgctgtcggacatgtattccgccatcacgtcggccatcggcacgcttaaaggtcctctgcacggcggcgccaatgagcaggtgatgcgcatgctgctcgaaattggcgatcccagcaaggccatcacgtggatcgacgaggcgctcgcgcagaagaagaagatcatgggcttcggccatcgcgtgtatcggaccgaggatccgcgcgcgacgcaccttcgcgagctcagcaagcaggcgggcgagctgaagggcgaaacgaaatggttcgagatgtcccaggccattgaaaagcacatgctcgaggtcaagggcctgcacgcgaacgtggacttctattcggcgtcgctctactattcgctcggcattccgacgcacctgtacacgcccatcttcgcgtgcagccgcatctccgggtggacggcgcacgtgctcgagcagtacaagaacaatcgcctcatccgcccgcgggccgagtacgtcggaccgacggataaaaagtttgtcccgctcagcgagcgctga

SEQ ID NO: 288 - DNA, 1134 bp, Artificial
  Substituion in SEQ ID NO 274
atggcagcggaaacgacattcaaagccgggctggaagacgtggtctccaacacgtctgaaatctgcttcttggatgggaaacagggtaaacttctgtactacggatatgatatccacgatctcgtcgatggcggcgcctcgtttgaggaggtcgtgtaccttctgtggcacggcgagctgccgaatcagtcggagctgaaagcgttcaccgaggaactcgccagcgagcgggcattggctgaacccgtgctcgatctcttgaaacgcctcccgaaggacgcgaatgcgatggccgtacttcgcacggcggtctccttcctcggtctgtatgatcccgatgacggcgatgagagcctggaggcaaactaccgcaaagccgcgcgcctcgtcgcgaagattccaaccatcgtgacctcctacgagcgcatccgccaaggactggaccccgtacaaccggatccttcgctgagcgccgctgcgaacttcttctatctcctccgtggcacgaagccttccgaattcgaggagaaggcattcaacaccgcactcattctgcacgcagatcacgaattgaacgcttcgacgttctcggcgcgcgtcacggcgggcacgctgtcggacatgtattccgccatcacgtcggccatcggcacgcttaaaggtcctctgcacggcggcgccaatgagcaggtgatgcgcatgctgctcgaaattggcgatcccagcaaggccatcacgtggatcgacgaggcgctcgcgcagaagaagaagatcatgggcttcggccatcgcgtgtatcggaccgaggatccgcgcgcgacgcaccttcgcgagctcagcaagcaggcgggcgagctgaagggcgaaacgaaatggttcgagatgtcccaggccattgaaaagcacatgctcgaggtcaagggcctgcacgcgaacgtggacttctattcggcgtcgctctactattcgctcggcattccgacgcacctgtacacgcccatcttcgcgtgcagccgcatctccgggtggacggcgcacgtgctcgagcagtacaagaacaatcgcctcatccgcccgcgggccgagtacgtcggaccgacggatcgcaagtttgtcccgctcagcgagcgctga

SEQ ID NO: 289 - DNA, 1134 bp, Artificial
  Substituion in SEQ ID NO 274
atggcagcggaaacgacattcaaagccgggctggaagacgtggtctccaacacgtctgaaatctgcttcttggatgggaaacagggtcgccttctgtactacggatatgatatccacgatctcgtcgatggcggcgcctcgtttgaggaggtcgtgtaccttctgtggcacggcgagctgccgaatcagtcggagctgaaagcgttcaccgaggaactcgccagcgagcgggcattggctgaacccgtgctcgatctcttgaaacgcctcccgaaggacgcgaatgcgatggccgtacttcgcacggcggtctccttcctcggtctgtatgatcccgatgacggcgatgagagcctggaggcaaactaccgcaaagccgcgcgcctcgtcgcgaagattccaaccatcgtgacctcctacgagcgcatccgcaatggactggaccccgtacaaccggatccttcgctgagcgccgctgcgaacttcttctatctcctccgtggcacgaagccttccgaattcgaggagaaggcattcaacaccgcactcattctgcacgcagatcacgaattgaacgcttcgacgttctcggcgcgcgtcacggcgggcacgctgtcggacatgtattccgccatcacgtcggccatcggcacgcttaaaggtcctctgcacggcggcgccaatgagcaggtgatgcgcatgctgctcgaaattggcgatcccagcaaggccatcacgtggatcgacgaggcgctcgcgcagaagaagaagatcatgggcttcggccatcgcgtgtatcggaccgaggatccgcgcgcgacgcaccttcgcgagctcagcaagcaggcgggcgagctgaagggcgaaacgaaatggttcgagatgtcccaggccattgaaaagcacatgctcgaggtcaagggcctgcacgcgaacgtggacttctattcggcgtcgctctactattcgctcggcattccgacgcacctgtacacgcccatcttcgcgtgcagccgcatctccgggtggacggcgcacgtgctcgagcagtacaagaacaatcgcctcatccgcccgcgggccgagtacgtcggaccgacggatcgcaagtttgtcccgctcagcgagcgctga

SEQ ID NO: 290 - protein, 1007 aa, Alicyclobacillus acidocaldarius
MCFAREVLRGNSDCGIHRNRKRIGFVLPVYSFSDTRPEFLLGIPGCPKAPQAGAPSCPVRVEEGFTMANEQPGSVQTFWHQFSGPNLAYLLEQYEQYLADPNAVPEDVRSLFAQYGDPAQAVSASPIETQPVFGPQVSALSPRTLEAAAKAHQLAQAIRANGHLAADTDPLFAPEGSPELEASTYGLVEADLASLPASVVGGPIAQTAPTALAAIEALRKAYCSDLGYEFAHLSSREERAWFEDQIENRRFHQPLTLDEAKALYELLARAQLFERFMHKRFVGQKRFSVEGVDALVPMVDALAKMAVDAGFDHVFIGMAHRGRLNILAHVLKKPYERIFSEFHAGNGMASDEELAEYMLGWGGDVKYHMGWTRTFETPNGHKARYVLSNNPSHLEFVDPVVEGMTRAAQDDRTRPGQPIQDVHKAFPILVHGDAAFTGEGVVAETLNFSKIPGYYTGGTVHIIANNHLGFTADPEQGRSTRYASDIAKGYDLPVVHVSADNPEACLRAVRLAFLYRETFQKDIVIDLVGYRRWGHNESDDPAMTQPVMYAKIASHPTVMEIYANELVARGAFTAADLQKIDQAIDEELLQAYKKYPEIHTPAAITDFSEPTEDAKPVPLEELKEINRALLETPPDFTVYPKLKRILERRRDALDGGDIDWAHAEALAFGTILRSGTPIRMSGQDSERGTFGQRHLVLHDANTNARYAPLQHLPGAKASFVVYNSPLSETAVIGFEYGYSVEAKDALVLWEAQYGDFANVGQPLFDNFIVAARSKWGETSGLVLLLPHGFEGQAHEHSSGRVERFLQLAARNNIVVANVTTSAQYFHLLRRQAARLKNPRPLVIMTPKSLLRNPLAASKPEDLTNGRFQPVLHFAKTGEGAQAVRRLILSSGKVGVDLAAEMSKRGEEACAHVATARVEQLYPFPADRVKDVIASYPNLQEVVWLQEEPENQGPWNFMRPRLQELLPASVKLRYIGRPEQGFVAEGSPDVHNRVQAEILAQALANDNH

SEQ ID NO: 291 - DNA, 3024 bp, Alicyclobacillus acidocaldarius
gtgtgctttgcgcgcgaagttttgcgcgggaattccgactgtggtatacatagaaatcggaaaaggatagggtttgtcctacccgtctattcattctctgacaccaggccggaattcctgcttgggatccccgggtgtcccaaggcgccccaagcgggtgctccgtcatgcccagtgcgcgtggaagaggggttcacaatggcgaacgaacaacctggatcagtgcagacgttctggcatcagttctcagggccgaacttggcctacctgctcgagcagtatgagcagtatctcgcggatcccaacgccgtgccggaggacgtgcgcagcttattcgcgcaatacggggatccggctcaggcggtatctgcttcaccgatagagacacaaccggtgttcggacctcaggtttccgctttgtcgcctcgcacgctggaggccgcggcgaaggcccaccaattggctcaagccatccgcgcgaacggccatctcgcggcggataccgatccgctgtttgctcccgaaggttctcccgaactggaagcgtcgacgtacggccttgtggaagccgatctcgcctcattgcccgcctcggtggtgggaggccccatcgcgcagactgcgccgaccgcactcgcggccatcgaggcgctgcggaaggcgtactgcagcgacctgggctacgagtttgcccatctttcgagccgcgaagagcgggcgtggttcgaggatcagatcgaaaaccgacggttccatcagccgctcaccttggacgaggcgaaggcgctttacgagctgctggcgcgcgcgcagttgttcgagcggttcatgcacaagcgcttcgtcggccagaagcggttttccgtcgaaggtgtcgacgcgctcgttcccatggtggatgcgcttgcgaagatggcggtggacgccggtttcgatcacgtcttcatcggcatggcgcaccgcggccgcctgaatatcctcgcgcacgtgctgaagaagccctacgagcgcatcttctccgagttccacgccggcaacggcatggcctcggacgaggaactcgcggaatacatgctcggctggggcggcgacgtaaagtaccacatgggctggacgcgcaccttcgagacgccgaacggccataaggcgcgctatgtgctgtccaacaacccgagccatttggaattcgtggatcccgtcgtcgaaggcatgacgcgcgcggcgcaggacgaccgcacgcggcccgggcagcccattcaggacgtgcacaaggcgttccccattctggttcacggcgacgccgcgttcaccggcgagggtgtggtcgctgagacgctcaacttctcgaagatccccggctattacaccggcggaacggtgcacatcatcgccaataaccacctcggcttcaccgctgacccggagcagggccggtcgacgcgttacgcgagcgacattgccaagggctacgatctgccggtcgtccacgtttccgcggacaatccggaagcgtgtctgcgcgcggtgcgcctcgccttcctgtatcgcgagacgttccagaaggacatcgtgatcgatctcgtcgggtatcgccgttggggccacaacgagtcggacgatcccgccatgacgcagccggtgatgtacgcgaagatcgcctcccatccgaccgtgatggagatctacgcaaacgagctcgtcgcgcggggcgcgttcacggcggcggacctgcagaagatcgatcaggccatcgacgaggaactgctgcaggcgtacaagaagtacccggagattcacacgcctgcggccatcacggacttctcggagcccacggaggacgcaaagcccgtacccctggaggaactgaaagagatcaaccgggcgctcttggagacgccgcccgacttcacggtgtacccgaagctgaagcgcatcctggagcggcgccgggacgcgctcgacggaggcgacatcgactgggcgcatgccgaggccctggcgtttggaaccatcctgcgatccggcacgcccatccgcatgtccggccaggactcggagcgcgggacgttcggccagcgccacctcgtgctccacgacgcgaacaccaacgcgcgctacgctccgctccagcacctgccgggagccaaggcgagctttgtggtgtacaatagcccgctttcggagacggccgtgatcgggttcgaatacggctattcggtcgaagcgaaggacgcgctcgttctgtgggaagcgcagtacggcgacttcgccaacgtcggtcagcccctgtttgacaacttcatcgtggccgcgcgatcgaagtggggggagacctccgggctggtgttgcttttgccgcacgggttcgaggggcaggcgcacgagcactcgagtggccgcgtggagcgattcctgcagctcgccgctcgcaacaacatcgtggtggcgaacgtgacgacctccgcgcagtacttccatctgctgcggcgccaggcggcacggctcaaaaacccgcgtccgctcgtcatcatgacgccgaagagcttgctcaggaacccgcttgcggcctcgaagccggaagatctgaccaacggccgatttcagccggttctgcacttcgccaagacgggggagggcgcgcaggcggttcgccgcctgattctctcgagtggcaaggtgggcgtcgatctcgccgcggagatgtcgaagcggggcgaggaggcgtgcgcgcacgtcgccaccgcgcgcgtcgagcagctgtacccgttcccggcggatcgcgtgaaggacgtcatcgcgtcgtatcccaacctgcaagaggtggtgtggctccaggaggagcccgagaaccaggggccgtggaacttcatgcggccgaggttgcaggaacttcttccggcgtcggtgaaactccgttatatcggccgtcccgagcagggctttgtcgcggaaggatcgccggacgtgcacaaccgcgtgcaggctgaaattttggcgcaggcgttggccaacgataaccattaa

SEQ ID NO: 292 - protein, 920 aa, Chloroflexus aurantiacus J-10-fl
WNGFYGPNAGYLIELYERYCADPNSVDEATRAFFAQWAPPSDSAAPAGEAGQPPLDVTRIVGAARLIRYIRELGHLAARIDPLGSDPPGDPGLELATHGVTQADLAALPAHIVRGPIATQVRNAAEGVERLRQAYSGSIGYETDQIQDYLERAWIREAAEDRRFFGGLDADRQRELLDRLTEVECFERFLHKTFPGQKRFSIEGCDMLIPMIDAIIRNAAVNGTKEVVIGMAHRGRLNVLAHILGKPYSMILTEFHSPDYTKDTYEGWTGDVKYHLGARKAYRESGIAEMPITLAPNPSHLEFINPVVEGRARAAQEHRNRPGFPEEDEKESLAILIHGDAAFPGQGIVAETLNLSRLKGYHTGGTIHIIINNQIGFTTDSNDSRSTLYASDLARGLEIPVVHVNADDVEACIAAARMASAYREKFQKDFLIDLVGYRRWGHNEGDEPEFTQPKMYERIRNHPTVREIWARELERRGIITREEAQARVDAVMNRLQQAFEKVRERQRLAASLPPAPPPPVQPLRRPPIFARPVSAKTLIELNEALLDRPEGFTVHPKLERTLQRRRQAIFEESGIDWGHAEALAFASILADGTPIRLTGQDSERGTFSHRHAVLHDVVTGERFIPLHHIPQARASFAVYNSPLSEASVLGFEYGYSCHAPDTLVLWEAQFGDFANGAQVIIDQFIVSGHAKWGQNPSLVMLLPHGYEGQGPEHSSARLERFLQLAANDNIRVANCTTAAQYFHLLRYQAASLYADPKPLIILTPKSLLRHPRSSSSLRDLTDHRFQPVLGLGAEAPAPEGVTRLILCSGKVAIDLLSSAEWEKTAGRVDVLRLELLYPFPAEELRMAMQRYPNLQEVVWLQEEPQNMGAWSFVWPRLQQLLPEGVTLRYVGRAESASPAEGLHSIHVREQARILREAVAD

SEQ ID NO: 293 - protein, 921 aa, Chloroflexus aggregans DSM 9485
WNGFYGPNAGYLLELYERYCADPNSVDEATRAFFAQWTPPDEITSSETRDGQPPLDVTRIVGAARLIRYIRELGHLAARIDPLGSDPPGDPGLELATHGVTQADLAALPAHIVRGPIASQVRNAAEGVERLRQAYSGSIGYETDQIQDYRERAWIREAAEDRRFFGGLDADRQRELLDRLTEVETFERFLHKTFPGQKRFSIEGCDMLIPMIDAIIRNAAASGTKEVVIGMAHRGRLNVLAHILGKPYSLILTEFHSPDYTKDTYEGWSGDVKYHLGARKAYRESGIAEMPITLAPNPSHLEFINPVVEGRARAAQERRNRPGFPEEDEKESLAILIHGDAAFPGQGIVAETLNLSRLKGYHIGGTIHIIINNQIGFTTDSSDSRSTLYASDLARGLEIPVVHVNADDVEACIAAARMASAYREKFQKDFLIDLVGYRRWGHNEGDEPEFTQPKMYERIRNHPTVREIWARELERRGIITREEAQARVNAVMNKLQQAFDKVRERQRLAAELPPAPAPAPSLPPRRPPIFARPVSAKTLIELNEALLDRPEGFTVHPKLERMLQRRRQAIYEENGIDWGHAEALAFASILADGTPIRLTGQDSERGTFSHRHAVLHDVVTGERFIPLHAIPQARASFAVYNSPLSEASVLGFEYGYSCHAPDTLVLWEAQFGDFANGAQVIIDQFIVSGHAKWGQNPSLVMLLPHGYEGQGPEHSSARLERFLQLAANDNIRIANCTTAAQYFHLLRYQATSLYADPKPLIILTPKSLLRHPRSSSSLRDLTDLRFQPVLGLGAEAPLPEGVTRLILCSGKVAIDLISSAEWEKTAGRADLLRLELLYPFPAEEVQAAIRRYPNLREVVWLQEEPQNMGAWTFVWPRLQTLLPTGVTLRYVGRAESSSPAEGLHSIHVREQARILREAVAN

SEQ ID NO: 294 - protein, 917 aa, Rubrobacter xylanophilus DSM 9941
QFYGPNLGYVLELYERYREDPGSVDEETRRFFERWSPPRIEVDGRVAGAALEAEKYVGAAKYIRSIRDFGHSAARLDPLGGEPPGDPALDPAFHGITEEDLERMPSSIVGGPIAERTSNAREAVEELKRIYCKTTGYDFGHIAHLPEERFWLRDAVESEQFYQRLEGEAARRLLRRLTRVDTFEKFLHRTFLGQKRFSVEGNDMVVPMLDRLIRHAADAGTPEVVMGMAHRGRLNVLAHVLNKPYAKIFGEFQQPERGEQSSVSEMSGEGWVGDVKYHLGVRNFHLEEGQEDAKVLINLAPNPSHLEHVNPVVSGMTRAAQERRDEAGPPRQDVDAALSIVLHGDAAFPGEGVAAETLNLYRLPGYRVGGTIHIITNNQLGFTTEKEDARSTTYASDLAKGYEIPVVHVNADDPEACLAAVSLAYAYRQRFHKDFMIDLIGYRRYGHNEGDEPVYTQPVMYEKIRNHPTVREIWARTLEERGVISEGEAEKMAEEMFARMQEIHKNPSEQLTEEDFDTEEPHTPLVDIPETAVEASRLEALNRAMLERPEGFSPNRKLERLFQKNRGSLERIDWAHAEALAFASLLEDGIPIRLTGQDSERGTFSQRHAVLHDEKTGEEYVPLQNIPQARASFDIHNSPLSEMAVMGFEYGYSVNAPDALTLWEAQYGDFANVGQPIIDQFIVSGQAKWGQVSNLVLLLPHGYEGQGPEHSSARLERFLQLAAGENIRVANPTTAAQYFHLLRAQAILKDHKRPLVLMTPKSLLRHPMAASGLQELAEGRFHPVLDDEEARERAGSVERLILCSGKIYTELVGSDFREEAEEVAIARVELLYPFPEGQIREVIAGYPNLRELVWVQEEPKNMGAWFFMEPRLREITGGELPIRYVGKPARPSPAQGSVSFHRREHAQIVREAFRRDS

SEQ ID NO: 295 - protein, 936 aa, Geobacillus kaustophilus HTA426
WSQFYGPNLGYVIEMYEQYLDDPNSIDPELKQLFEQWGAPVLEEPVSPADDETAKTHQTFRLPETPTIFSKLVAAVKLADSIRHYGHLVADTNPLVKKEKKLRRLELDEYDLTEEDLKRIPVAFLCPHAPAHVKNGWDAILHLRKIYTDKIAFEFSQVHNLEERNWLIQQIESGAYYPSLANKERVALLRRLTEVEGFEKFIHRTYVGQKRFSIEGLDSMVPLLDELVRQAIEHEIDAVNIGMAHRGRLNVLAHVLGKPYEMIFAEFQHAESKNFIPSEGSVAITYGWTGDVKYHLGAARRLRNQSAHTMRITLANNPSHLEVVNPVVLGYTRAAQEDRTKPGVPVQNTDASFAILIHGDAAFPGQGIVAETLNLSQLRGYTTGGTIHIIANNMIGFTTESYDSRSTTYASDMAKGFEVPIVHVNADDPEACLAAACLAFAYRQRFKKDFVIDLIGYRRFGHNEMDEPMATNPTMYAIINQHPTVRKLYAQKLMEKGIITEREVDEMEQEVAERLKIAYERVPKNEDELDFIMDPPKPVVDRLPEVKTSVAKDVLHRVNEELLQFPDGFNVFNKLERILKRRSGVFAQNGKVDWAHAEILAFATILQDGVPIRLTGQDSQRGTFAQRHLVLHDVKTGEEYVPLHHISGAKASFVVYNSPLTEAAVLGYEYGYNVYAPETLVLWEAQFGDFANMAQVMFDQFISSGRAKWGQKSGLVMLLPHGYEGQGPEHSSGRVERFLQLAAENNWTVANLSTAAQYFHILRRQAALLTREEVRPLIIMTPKSLLRHPLAASDAEVFVDGAFSPVLEQPGLGADAGKVERIVFGTGKLMIDLAEQIGKMESLDWLHIVRIEELYPFPEEAVKDIIARYPNVKELVWVQEEPKNMGAWLYMEPRLRALAPEGVDVSYIGRRRRASPAEGDPVVHRKEQERIIRCAL

SEQ ID NO: 296 - protein, 915 aa, Geobacillus thermodenitrificans NG80-2
DPDSVDPELKQLFEQWGAPVVEEPVSPADPEATQTHQTFRLPETPTVFSKLVAAVKLADSIRHYGHLAADTNPIVKKEKKLRRLELDEYDLTEEDLKRIPVAFLCPHAPAHVKNGWDAILHLRKIYTDKIAFEFSQVHNLEERNWLIQQIESGAYYPSLANKERVALLRRLTEVEGFEKFIHRTYVGQKRFSIEGLDSMVPLLDELVRQAIEHEIDAVNIGMAHRGRLNVLAHVLGKPYEMIFAEFQHAESKNFIPSEGAVAITYGWTGDVKYHLGAARRLRNKSAHTMRITLANNPSHLEVVNPVVLGYTRAAQEDRTKPGVPEQKVDASFAILIHGDAAFPGQGVVAETLNLSQLRGYTTGGAIHIIANNMIGFTTESYDSRSTTYASDMAKGFEVPIVHVNADDPEACLAAASLAFAYRQRFKKDFVIDLIGYRRFGHNEMDEPMATNPLMYSIIHQHPTVRQLYAQKLIDKGIIAEREVEEMEQEVAERLKIAYERVPKNEEELDFIMDPPKPVVDRLPEVKTGVAKDVLHRINEELLEFPADFHVFNKLERILKRRSNVFAQNGKIDWAHAETLAFATILQDGVPIRLTGQDSQRGTFAQRHLVLHDVKTGKEYVPLHHISGAKASFVVYNSPLTEAAVLGYEYGYNVYAPETLVLWEAQFGDFANMAQVMFDQFISSGRAKWGQKSGLVMLLPHGYEGQGPEHSSGRIERFLQLAAENNWTVANLSTAAQYFHILRRQAALLKKEEVRPLVLMTPKSLLRHPLASSEAEALVQGAFSPVLEQPGLGVDASKVERIVFGTGKLMIDLAEQIGKMDGLDWLHVVRVEELYPFPEEAVQAIIARYPNVKELVWVQEEPKNMGAWMYMEPRLRAIAPEGVDVSYIGRRRRASPAEGDPVVHRKEQERIIRCAL

SEQ ID NO: 297 - protein, 1007 aa, Artificial
  Substituion in SEQ ID NO 290
MCFAREVLRGNSDCGIHRNRKRIGFVLPVYSFSDTRPEFLLGIPGCPKAPQAGAPSCPVRVEEGFTMANEQPGSVQTFWHQFSGPNLAYLLEQYEQYLADPNAVPEDVRSLFAQYGDPAQAVSASPIETQPVFGPQVSALSPRTLDAAAKAHQLAQAIRANGHLAADTDPLFAPEGSPELEASTYGLVEADLASLPASVVGGPIAQTAPTALAAIEALRKAYCSDLGYEFAHLSSREERAWFEDQIENRRFHQPLTLDEAKALYELLARAQLFERFMHKRFVGQKRFSVEGVDALVPMVDALAKMAVDAGFDHVFIGMAHRGRLNILAHVLKKPYERIFSEFHAGNGMASDEELAEYMLGWGGDVKYHMGWTRTFETPNGHKARYVLSNNPSHLEFVDPVVEGMTRAAQDDRTRPGQPIQDVHKAFPILVHGDAAFTGEGVVAETLNFSKIPGYYTGGTVHIIANNHLGFTADPEQGRSTRYASDIAKGYDLPVVHVSADNPEACLRAVRLAFLYRETFQKDIVIDLVGYRRWGHNESDDPAMTQPVMYAKIASHPTVMEIYANELVARGAFTAADLQKIDQAIDEELLQAYKKYPEIHTPAAITDFSEPTEDAKPVPLEELKEINRALLETPPDFTVYPKLKRILERRRDALDGGDIDWAHAEALAFGTILRSGTPIRMSGQDSERGTFGQRHLVLHDANTNARYAPLQHLPGAKASFVVYNSPLSETAVIGFEYGYSVEAKDALVLWEAQYGDFANVGQPLFDNFIVAARSKWGETSGLVLLLPHGFEGQAHEHSSGRVERFLQLAARNNIVVANVTTSAQYFHLLRRQAARLKNPRPLVIMTPKSLLRNPLAASKPEDLTNGRFQPVLHFAKTGEGAQAVRRLILSSGKVGVDLAAEMSKRGEEACAHVATARVEQLYPFPADRVKDVIASYPNLQEVVWLQEEPENQGPWNFMRPRLQELLPASVKLRYIGRPEQGFVAEGSPDVHNRVQAEILAQALANDNH

SEQ ID NO: 298 - protein, 1007 aa, Artificial
  Substituion in SEQ ID NO 290
MCFAREVLRGNSDCGIHRNRKRIGFVLPVYSFSDTRPEFLLGIPGCPKAPQAGAPSCPVRVEEGFTMANEQPGSVQTFWHQFSGPNLAYLLEQYEQYLADPNAVPEDVRSLFAQYGDPAQAVSASPIETQPVFGPQVSALSPRTLEAAAKAHQLAQAIRANGHLAADTDPLFAPEGSPELEASTYGLVEADLASLPASVVGGPIAQTAPTALAAIEALRKAYCSDLGYEFAHLSSREERAWFEDQIENRRFHQPLTLDEAKALYELLARAQLFERFMHKRFVGQKRFSVEGVDALVPMVDALAKMAVDAGFDHVFIGMAHRGRLNILAHVLKKPYERIFSEFHAGNGMASDEELAEYMLGWGGDVKYHMGWTRTFETPNGHKARYVLSNNPSHLEFVDPVVEGMTRAAQDDRTRPGQPIQDVHKAFPILVHGDAAFTGEGVVAETLNFSKIPGYYTGGTVHIIANNHLGFTADPEQGRSTRYASDIAKGYDLPVVHVSADNPEACLRAVRLAFLYRETFQKDIVIDLVGYRRWGHNESDDPAMTQPVMYAKIASHPTVMEIYANELVARGAFTAADLQKIDQAIDEELLQAYKKYPEIHTPAAITDFSEPTEDAKPVPLEELKEINRALLETPPDFTVYPKLKRILERRRDALDGGDIDWAHAEALAFGTILRSGTPIRMSGQDSERGTFGQRHLVLHDANTNARYAPLQHLPGAKASFVVYNSPLSETAVIGFEYGYSVEAKDALVLWEAQYGDFANVGQPLFDNFIVAARSKWGETSGLVLLLPHGFEGQAHEHSSGRVERFLQLAARNNIVVANVTTSAQYFHLLRRQAARLKNPRPLVIMTPKSLLRNPLAASKPEDLTNGRFQPVLHFARTGEGAQAVRRLILSSGKVGVDLAAEMSKRGEEACAHVATARVEQLYPFPADRVKDVIASYPNLQEVVWLQEEPENQGPWNFMRPRLQELLPASVKLRYIGRPEQGFVAEGSPDVHNRVQAEILAQALANDNH

SEQ ID NO: 299 - protein, 1007 aa, Artificial
  Substituion in SEQ ID NO 290
MCFAREVLRGNSDCGIHRNRKRIGFVLPVYSFSDTRPEFLLGIPGCPKAPQAGAPSCPVRVEEGFTMANEQPGSVQTFWHQFSGPNLAYLLEQYEQYLADPNAVPEDVRSLFAQYGEPAQAVSASPIETQPVFGPQVSALSPRTLEAAAKAHQLAQAIRANGHLAADTDPLFAPEGSPELEASTYGLVEADLASLPASVVGGPIAQTAPTALAAIEALRKAYCSDLGYEFAHLSSREERAWFEDQIENRRFHQPLTLDEAKALYELLARAQLFERFMHKRFVGQKRFSVEGVDALVPMVDALAKMAVDAGFDHVFIGMAHRGRLNILAHVLKKPYERIFSEFHAGNGMASDEELAEYMLGWGGDVKYHMGWTRTFETPNGHKARYVLSNNPSHLEFVDPVVEGMTRAAQDDRTRPGQPIQDVHKAFPILVHGDAAFTGEGVVAETLNFSKIPGYYTGGTVHIIANNHLGFTADPEQGRSTRYASDIAKGYDLPVVHVSADNPEACLRAVRLAFLYRETFQKDIVIDLVGYRRWGHNESDDPAMTQPVMYAKIASHPTVMEIYANELVARGAFTAADLQKIDQAIDEELLQAYKKYPEIHTPAAITDFSEPTEDAKPVPLEELKEINRALLETPPDFTVYPKLKRILERRRDALDGGDIDWAHAEALAFGTILRSGTPIRMSGQDSERGTFGQRHLVLHDANTNARYAPLQHLPGAKASFVVYNSPLSETAVIGFEYGYSVEAKDALVLWEAQYGDFANVGQPLFDNFIVAARSKWGETSGLVLLLPHGFEGQAHEHSSGRVERFLQLAARNNIVVANVTTSAQYFHLLRRQAARLKNPRPLVIMTPKSLLRNPLAASKPEDLTNGRFQPVLHFAKTGEGAQAVRRLILSSGKVGVDLAAEMSKRGEEACAHVATARVEQLYPFPADRVKDVIASYPNLQEVVWLQEEPENQGPWNFMRPRLQELLPASVKLRYIGRPEQGFVAEGSPDVHNRVQAEILAQALANDNH

SEQ ID NO: 300 - protein, 1007 aa, Artificial
  Substituion in SEQ ID NO 290
MCFAREVLRGNSDCGIHRNRKRIGFVLPVYSFSDTRPEFLLGIPGCPKAPQAGAPSCPVRVEEGFTMANEQPGSVQTFWHQFSGPNLAYLLEQYEQYLADPNAVPEDVRSLFAQYGDPAQAVSASPIETQPVFGPQVSALSPRTLEAAAKAHQLAQAIRANGHLAADTDPLFAPEGSPELEASTYGLVEADLASLPASVVGGPIAQTAPTALAAIEALRKAYCSELGYEFAHLSSREERAWFEDQIENRRFHQPLTLDEAKALYELLARAQLFERFMHKRFVGQKRFSVEGVDALVPMVDALAKMAVDAGFDHVFIGMAHRGRLNILAHVLKKPYERIFSEFHAGNGMASDEELAEYMLGWGGDVKYHMGWTRTFETPNGHKARYVLSNNPSHLEFVDPVVEGMTRAAQDDRTRPGQPIQDVHKAFPILVHGDAAFTGEGVVAETLNFSKIPGYYTGGTVHIIANNHLGFTADPEQGRSTRYASDIAKGYDLPVVHVSADNPEACLRAVRLAFLYRETFQKDIVIDLVGYRRWGHNESDDPAMTQPVMYAKIASHPTVMEIYANELVARGAFTAADLQKIDQAIDEELLQAYKKYPEIHTPAAITDFSEPTEDAKPVPLEELKEINRALLETPPDFTVYPKLKRILERRRDALDGGDIDWAHAEALAFGTILRSGTPIRMSGQDSERGTFGQRHLVLHDANTNARYAPLQHLPGAKASFVVYNSPLSETAVIGFEYGYSVEAKDALVLWEAQYGDFANVGQPLFDNFIVAARSKWGETSGLVLLLPHGFEGQAHEHSSGRVERFLQLAARNNIVVANVTTSAQYFHLLRRQAARLKNPRPLVIMTPKSLLRNPLAASKPEDLTNGRFQPVLHFAKTGEGAQAVRRLILSSGKVGVDLAAEMSKRGEEACAHVATARVEQLYPFPADRVKDVIASYPNLQEVVWLQEEPENQGPWNFMRPRLQELLPASVKLRYIGRPEQGFVAEGSPDVHNRVQAEILAQALANDNH

SEQ ID NO: 301 - protein, 1007 aa, Artificial
  Substituion in SEQ ID NO 290
MCFAREVLRGNSDCGIHRNRKRIGFVLPVYSFSDTRPEFLLGIPGCPKAPQAGAPSCPVRVEEGFTMANEQPGSVQTFWHQFSGPNLAYLLEQYEQYLADPNAVPEDVRSLFAQYGDPAQAVSASPIETQPVFGPQVSALSPRTLEAAAKAHQLAQAIRANGHLAADTDPLFAPEGSPELEASTYGLVEADLASLPASVVGGPIAQTAPTALAAIEALRKAYCSDLGYEFAHLSSREERAWFEDQIENRRFHQPLTLDDAKALYELLARAQLFERFMHKRFVGQKRFSVEGVDALVPMVDALAKMAVDAGFDHVFIGMAHRGRLNILAHVLKKPYERIFSEFHAGNGMASDEELAEYMLGWGGDVKYHMGWTRTFETPNGHKARYVLSNNPSHLEFVDPVVEGMTRAAQDDRTRPGQPIQDVHKAFPILVHGDAAFTGEGVVAETLNFSKIPGYYTGGTVHIIANNHLGFTADPEQGRSTRYASDIAKGYDLPVVHVSADNPEACLRAVRLAFLYRETFQKDIVIDLVGYRRWGHNESDDPAMTQPVMYAKIASHPTVMEIYANELVARGAFTAADLQKIDQAIDEELLQAYKKYPEIHTPAAITDFSEPTEDAKPVPLEELKEINRALLETPPDFTVYPKLKRILERRRDALDGGDIDWAHAEALAFGTILRSGTPIRMSGQDSERGTFGQRHLVLHDANTNARYAPLQHLPGAKASFVVYNSPLSETAVIGFEYGYSVEAKDALVLWEAQYGDFANVGQPLFDNFIVAARSKWGETSGLVLLLPHGFEGQAHEHSSGRVERFLQLAARNNIVVANVTTSAQYFHLLRRQAARLKNPRPLVIMTPKSLLRNPLAASKPEDLTNGRFQPVLHFAKTGEGAQAVRRLILSSGKVGVDLAAEMSKRGEEACAHVATARVEQLYPFPADRVKDVIASYPNLQEVVWLQEEPENQGPWNFMRPRLQELLPASVKLRYIGRPEQGFVAEGSPDVHNRVQAEILAQALANDNH

SEQ ID NO: 302 - DNA, 3024 bp, Artificial
  Substituion in SEQ ID NO 291
gtgtgctttgcgcgcgaagttttgcgcgggaattccgactgtggtatacatagaaatcggaaaaggatagggtttgtcctacccgtctattcattctctgacaccaggccggaattcctgcttgggatccccgggtgtcccaaggcgccccaagcgggtgctccgtcatgcccagtgcgcgtggaagaggggttcacaatggcgaacgaacaacctggatcagtgcagacgttctggcatcagttctcagggccgaacttggcctacctgctcgagcagtatgagcagtatctcgcggatcccaacgccgtgccggaggacgtgcgcagcttattcgcgcaatacggggatccggctcaggcggtatctgcttcaccgatagagacacaaccggtgttcggacctcaggtttccgctttgtcgcctcgcacgctggatgccgcggcgaaggcccaccaattggctcaagccatccgcgcgaacggccatctcgcggcggataccgatccgctgtttgctcccgaaggttctcccgaactggaagcgtcgacgtacggccttgtggaagccgatctcgcctcattgcccgcctcggtggtgggaggccccatcgcgcagactgcgccgaccgcactcgcggccatcgaggcgctgcggaaggcgtactgcagcgacctgggctacgagtttgcccatctttcgagccgcgaagagcgggcgtggttcgaggatcagatcgaaaaccgacggttccatcagccgctcaccttggacgaggcgaaggcgctttacgagctgctggcgcgcgcgcagttgttcgagcggttcatgcacaagcgcttcgtcggccagaagcggttttccgtcgaaggtgtcgacgcgctcgttcccatggtggatgcgcttgcgaagatggcggtggacgccggtttcgatcacgtcttcatcggcatggcgcaccgcggccgcctgaatatcctcgcgcacgtgctgaagaagccctacgagcgcatcttctccgagttccacgccggcaacggcatggcctcggacgaggaactcgcggaatacatgctcggctggggcggcgacgtaaagtaccacatgggctggacgcgcaccttcgagacgccgaacggccataaggcgcgctatgtgctgtccaacaacccgagccatttggaattcgtggatcccgtcgtcgaaggcatgacgcgcgcggcgcaggacgaccgcacgcggcccgggcagcccattcaggacgtgcacaaggcgttccccattctggttcacggcgacgccgcgttcaccggcgagggtgtggtcgctgagacgctcaacttctcgaagatccccggctattacaccggcggaacggtgcacatcatcgccaataaccacctcggcttcaccgctgacccggagcagggccggtcgacgcgttacgcgagcgacattgccaagggctacgatctgccggtcgtccacgtttccgcggacaatccggaagcgtgtctgcgcgcggtgcgcctcgccttcctgtatcgcgagacgttccagaaggacatcgtgatcgatctcgtcgggtatcgccgttggggccacaacgagtcggacgatcccgccatgacgcagccggtgatgtacgcgaagatcgcctcccatccgaccgtgatggagatctacgcaaacgagctcgtcgcgcggggcgcgttcacggcggcggacctgcagaagatcgatcaggccatcgacgaggaactgctgcaggcgtacaagaagtacccggagattcacacgcctgcggccatcacggacttctcggagcccacggaggacgcaaagcccgtacccctggaggaactgaaagagatcaaccgggcgctcttggagacgccgcccgacttcacggtgtacccgaagctgaagcgcatcctggagcggcgccgggacgcgctcgacggaggcgacatcgactgggcgcatgccgaggccctggcgtttggaaccatcctgcgatccggcacgcccatccgcatgtccggccaggactcggagcgcgggacgttcggccagcgccacctcgtgctccacgacgcgaacaccaacgcgcgctacgctccgctccagcacctgccgggagccaaggcgagctttgtggtgtacaatagcccgctttcggagacggccgtgatcgggttcgaatacggctattcggtcgaagcgaaggacgcgctcgttctgtgggaagcgcagtacggcgacttcgccaacgtcggtcagcccctgtttgacaacttcatcgtggccgcgcgatcgaagtggggggagacctccgggctggtgttgcttttgccgcacgggttcgaggggcaggcgcacgagcactcgagtggccgcgtggagcgattcctgcagctcgccgctcgcaacaacatcgtggtggcgaacgtgacgacctccgcgcagtacttccatctgctgcggcgccaggcggcacggctcaaaaacccgcgtccgctcgtcatcatgacgccgaagagcttgctcaggaacccgcttgcggcctcgaagccggaagatctgaccaacggccgatttcagccggttctgcacttcgccaagacgggggagggcgcgcaggcggttcgccgcctgattctctcgagtggcaaggtgggcgtcgatctcgccgcggagatgtcgaagcggggcgaggaggcgtgcgcgcacgtcgccaccgcgcgcgtcgagcagctgtacccgttcccggcggatcgcgtgaaggacgtcatcgcgtcgtatcccaacctgcaagaggtggtgtggctccaggaggagcccgagaaccaggggccgtggaacttcatgcggccgaggttgcaggaacttcttccggcgtcggtgaaactccgttatatcggccgtcccgagcagggctttgtcgcggaaggatcgccggacgtgcacaaccgcgtgcaggctgaaattttggcgcaggcgttggccaacgataaccattaa

SEQ ID NO: 303 - DNA, 3024 bp, Artificial
  Substituion in SEQ ID NO 291
gtgtgctttgcgcgcgaagttttgcgcgggaattccgactgtggtatacatagaaatcggaaaaggatagggtttgtcctacccgtctattcattctctgacaccaggccggaattcctgcttgggatccccgggtgtcccaaggcgccccaagcgggtgctccgtcatgcccagtgcgcgtggaagaggggttcacaatggcgaacgaacaacctggatcagtgcagacgttctggcatcagttctcagggccgaacttggcctacctgctcgagcagtatgagcagtatctcgcggatcccaacgccgtgccggaggacgtgcgcagcttattcgcgcaatacggggatccggctcaggcggtatctgcttcaccgatagagacacaaccggtgttcggacctcaggtttccgctttgtcgcctcgcacgctggaggccgcggcgaaggcccaccaattggctcaagccatccgcgcgaacggccatctcgcggcggataccgatccgctgtttgctcccgaaggttctcccgaactggaagcgtcgacgtacggccttgtggaagccgatctcgcctcattgcccgcctcggtggtgggaggccccatcgcgcagactgcgccgaccgcactcgcggccatcgaggcgctgcggaaggcgtactgcagcgacctgggctacgagtttgcccatctttcgagccgcgaagagcgggcgtggttcgaggatcagatcgaaaaccgacggttccatcagccgctcaccttggacgaggcgaaggcgctttacgagctgctggcgcgcgcgcagttgttcgagcggttcatgcacaagcgcttcgtcggccagaagcggttttccgtcgaaggtgtcgacgcgctcgttcccatggtggatgcgcttgcgaagatggcggtggacgccggtttcgatcacgtcttcatcggcatggcgcaccgcggccgcctgaatatcctcgcgcacgtgctgaagaagccctacgagcgcatcttctccgagttccacgccggcaacggcatggcctcggacgaggaactcgcggaatacatgctcggctggggcggcgacgtaaagtaccacatgggctggacgcgcaccttcgagacgccgaacggccataaggcgcgctatgtgctgtccaacaacccgagccatttggaattcgtggatcccgtcgtcgaaggcatgacgcgcgcggcgcaggacgaccgcacgcggcccgggcagcccattcaggacgtgcacaaggcgttccccattctggttcacggcgacgccgcgttcaccggcgagggtgtggtcgctgagacgctcaacttctcgaagatccccggctattacaccggcggaacggtgcacatcatcgccaataaccacctcggcttcaccgctgacccggagcagggccggtcgacgcgttacgcgagcgacattgccaagggctacgatctgccggtcgtccacgtttccgcggacaatccggaagcgtgtctgcgcgcggtgcgcctcgccttcctgtatcgcgagacgttccagaaggacatcgtgatcgatctcgtcgggtatcgccgttggggccacaacgagtcggacgatcccgccatgacgcagccggtgatgtacgcgaagatcgcctcccatccgaccgtgatggagatctacgcaaacgagctcgtcgcgcggggcgcgttcacggcggcggacctgcagaagatcgatcaggccatcgacgaggaactgctgcaggcgtacaagaagtacccggagattcacacgcctgcggccatcacggacttctcggagcccacggaggacgcaaagcccgtacccctggaggaactgaaagagatcaaccgggcgctcttggagacgccgcccgacttcacggtgtacccgaagctgaagcgcatcctggagcggcgccgggacgcgctcgacggaggcgacatcgactgggcgcatgccgaggccctggcgtttggaaccatcctgcgatccggcacgcccatccgcatgtccggccaggactcggagcgcgggacgttcggccagcgccacctcgtgctccacgacgcgaacaccaacgcgcgctacgctccgctccagcacctgccgggagccaaggcgagctttgtggtgtacaatagcccgctttcggagacggccgtgatcgggttcgaatacggctattcggtcgaagcgaaggacgcgctcgttctgtgggaagcgcagtacggcgacttcgccaacgtcggtcagcccctgtttgacaacttcatcgtggccgcgcgatcgaagtggggggagacctccgggctggtgttgcttttgccgcacgggttcgaggggcaggcgcacgagcactcgagtggccgcgtggagcgattcctgcagctcgccgctcgcaacaacatcgtggtggcgaacgtgacgacctccgcgcagtacttccatctgctgcggcgccaggcggcacggctcaaaaacccgcgtccgctcgtcatcatgacgccgaagagcttgctcaggaacccgcttgcggcctcgaagccggaagatctgaccaacggccgatttcagccggttctgcacttcgcccgtacgggggagggcgcgcaggcggttcgccgcctgattctctcgagtggcaaggtgggcgtcgatctcgccgcggagatgtcgaagcggggcgaggaggcgtgcgcgcacgtcgccaccgcgcgcgtcgagcagctgtacccgttcccggcggatcgcgtgaaggacgtcatcgcgtcgtatcccaacctgcaagaggtggtgtggctccaggaggagcccgagaaccaggggccgtggaacttcatgcggccgaggttgcaggaacttcttccggcgtcggtgaaactccgttatatcggccgtcccgagcagggctttgtcgcggaaggatcgccggacgtgcacaaccgcgtgcaggctgaaattttggcgcaggcgttggccaacgataaccattaa

SEQ ID NO: 304 - DNA, 3024 bp, Artificial
  Substituion in SEQ ID NO 291
gtgtgctttgcgcgcgaagttttgcgcgggaattccgactgtggtatacatagaaatcggaaaaggatagggtttgtcctacccgtctattcattctctgacaccaggccggaattcctgcttgggatccccgggtgtcccaaggcgccccaagcgggtgctccgtcatgcccagtgcgcgtggaagaggggttcacaatggcgaacgaacaacctggatcagtgcagacgttctggcatcagttctcagggccgaacttggcctacctgctcgagcagtatgagcagtatctcgcggatcccaacgccgtgccggaggacgtgcgcagcttattcgcgcaatacggggaaccggctcaggcggtatctgcttcaccgatagagacacaaccggtgttcggacctcaggtttccgctttgtcgcctcgcacgctggaggccgcggcgaaggcccaccaattggctcaagccatccgcgcgaacggccatctcgcggcggataccgatccgctgtttgctcccgaaggttctcccgaactggaagcgtcgacgtacggccttgtggaagccgatctcgcctcattgcccgcctcggtggtgggaggccccatcgcgcagactgcgccgaccgcactcgcggccatcgaggcgctgcggaaggcgtactgcagcgacctgggctacgagtttgcccatctttcgagccgcgaagagcgggcgtggttcgaggatcagatcgaaaaccgacggttccatcagccgctcaccttggacgaggcgaaggcgctttacgagctgctggcgcgcgcgcagttgttcgagcggttcatgcacaagcgcttcgtcggccagaagcggttttccgtcgaaggtgtcgacgcgctcgttcccatggtggatgcgcttgcgaagatggcggtggacgccggtttcgatcacgtcttcatcggcatggcgcaccgcggccgcctgaatatcctcgcgcacgtgctgaagaagccctacgagcgcatcttctccgagttccacgccggcaacggcatggcctcggacgaggaactcgcggaatacatgctcggctggggcggcgacgtaaagtaccacatgggctggacgcgcaccttcgagacgccgaacggccataaggcgcgctatgtgctgtccaacaacccgagccatttggaattcgtggatcccgtcgtcgaaggcatgacgcgcgcggcgcaggacgaccgcacgcggcccgggcagcccattcaggacgtgcacaaggcgttccccattctggttcacggcgacgccgcgttcaccggcgagggtgtggtcgctgagacgctcaacttctcgaagatccccggctattacaccggcggaacggtgcacatcatcgccaataaccacctcggcttcaccgctgacccggagcagggccggtcgacgcgttacgcgagcgacattgccaagggctacgatctgccggtcgtccacgtttccgcggacaatccggaagcgtgtctgcgcgcggtgcgcctcgccttcctgtatcgcgagacgttccagaaggacatcgtgatcgatctcgtcgggtatcgccgttggggccacaacgagtcggacgatcccgccatgacgcagccggtgatgtacgcgaagatcgcctcccatccgaccgtgatggagatctacgcaaacgagctcgtcgcgcggggcgcgttcacggcggcggacctgcagaagatcgatcaggccatcgacgaggaactgctgcaggcgtacaagaagtacccggagattcacacgcctgcggccatcacggacttctcggagcccacggaggacgcaaagcccgtacccctggaggaactgaaagagatcaaccgggcgctcttggagacgccgcccgacttcacggtgtacccgaagctgaagcgcatcctggagcggcgccgggacgcgctcgacggaggcgacatcgactgggcgcatgccgaggccctggcgtttggaaccatcctgcgatccggcacgcccatccgcatgtccggccaggactcggagcgcgggacgttcggccagcgccacctcgtgctccacgacgcgaacaccaacgcgcgctacgctccgctccagcacctgccgggagccaaggcgagctttgtggtgtacaatagcccgctttcggagacggccgtgatcgggttcgaatacggctattcggtcgaagcgaaggacgcgctcgttctgtgggaagcgcagtacggcgacttcgccaacgtcggtcagcccctgtttgacaacttcatcgtggccgcgcgatcgaagtggggggagacctccgggctggtgttgcttttgccgcacgggttcgaggggcaggcgcacgagcactcgagtggccgcgtggagcgattcctgcagctcgccgctcgcaacaacatcgtggtggcgaacgtgacgacctccgcgcagtacttccatctgctgcggcgccaggcggcacggctcaaaaacccgcgtccgctcgtcatcatgacgccgaagagcttgctcaggaacccgcttgcggcctcgaagccggaagatctgaccaacggccgatttcagccggttctgcacttcgccaagacgggggagggcgcgcaggcggttcgccgcctgattctctcgagtggcaaggtgggcgtcgatctcgccgcggagatgtcgaagcggggcgaggaggcgtgcgcgcacgtcgccaccgcgcgcgtcgagcagctgtacccgttcccggcggatcgcgtgaaggacgtcatcgcgtcgtatcccaacctgcaagaggtggtgtggctccaggaggagcccgagaaccaggggccgtggaacttcatgcggccgaggttgcaggaacttcttccggcgtcggtgaaactccgttatatcggccgtcccgagcagggctttgtcgcggaaggatcgccggacgtgcacaaccgcgtgcaggctgaaattttggcgcaggcgttggccaacgataaccattaa

SEQ ID NO: 305 - DNA, 3024 bp, Artificial
  Substituion in SEQ ID NO 291
gtgtgctttgcgcgcgaagttttgcgcgggaattccgactgtggtatacatagaaatcggaaaaggatagggtttgtcctacccgtctattcattctctgacaccaggccggaattcctgcttgggatccccgggtgtcccaaggcgccccaagcgggtgctccgtcatgcccagtgcgcgtggaagaggggttcacaatggcgaacgaacaacctggatcagtgcagacgttctggcatcagttctcagggccgaacttggcctacctgctcgagcagtatgagcagtatctcgcggatcccaacgccgtgccggaggacgtgcgcagcttattcgcgcaatacggggatccggctcaggcggtatctgcttcaccgatagagacacaaccggtgttcggacctcaggtttccgctttgtcgcctcgcacgctggaggccgcggcgaaggcccaccaattggctcaagccatccgcgcgaacggccatctcgcggcggataccgatccgctgtttgctcccgaaggttctcccgaactggaagcgtcgacgtacggccttgtggaagccgatctcgcctcattgcccgcctcggtggtgggaggccccatcgcgcagactgcgccgaccgcactcgcggccatcgaggcgctgcggaaggcgtactgcagcgaactgggctacgagtttgcccatctttcgagccgcgaagagcgggcgtggttcgaggatcagatcgaaaaccgacggttccatcagccgctcaccttggacgaggcgaaggcgctttacgagctgctggcgcgcgcgcagttgttcgagcggttcatgcacaagcgcttcgtcggccagaagcggttttccgtcgaaggtgtcgacgcgctcgttcccatggtggatgcgcttgcgaagatggcggtggacgccggtttcgatcacgtcttcatcggcatggcgcaccgcggccgcctgaatatcctcgcgcacgtgctgaagaagccctacgagcgcatcttctccgagttccacgccggcaacggcatggcctcggacgaggaactcgcggaatacatgctcggctggggcggcgacgtaaagtaccacatgggctggacgcgcaccttcgagacgccgaacggccataaggcgcgctatgtgctgtccaacaacccgagccatttggaattcgtggatcccgtcgtcgaaggcatgacgcgcgcggcgcaggacgaccgcacgcggcccgggcagcccattcaggacgtgcacaaggcgttccccattctggttcacggcgacgccgcgttcaccggcgagggtgtggtcgctgagacgctcaacttctcgaagatccccggctattacaccggcggaacggtgcacatcatcgccaataaccacctcggcttcaccgctgacccggagcagggccggtcgacgcgttacgcgagcgacattgccaagggctacgatctgccggtcgtccacgtttccgcggacaatccggaagcgtgtctgcgcgcggtgcgcctcgccttcctgtatcgcgagacgttccagaaggacatcgtgatcgatctcgtcgggtatcgccgttggggccacaacgagtcggacgatcccgccatgacgcagccggtgatgtacgcgaagatcgcctcccatccgaccgtgatggagatctacgcaaacgagctcgtcgcgcggggcgcgttcacggcggcggacctgcagaagatcgatcaggccatcgacgaggaactgctgcaggcgtacaagaagtacccggagattcacacgcctgcggccatcacggacttctcggagcccacggaggacgcaaagcccgtacccctggaggaactgaaagagatcaaccgggcgctcttggagacgccgcccgacttcacggtgtacccgaagctgaagcgcatcctggagcggcgccgggacgcgctcgacggaggcgacatcgactgggcgcatgccgaggccctggcgtttggaaccatcctgcgatccggcacgcccatccgcatgtccggccaggactcggagcgcgggacgttcggccagcgccacctcgtgctccacgacgcgaacaccaacgcgcgctacgctccgctccagcacctgccgggagccaaggcgagctttgtggtgtacaatagcccgctttcggagacggccgtgatcgggttcgaatacggctattcggtcgaagcgaaggacgcgctcgttctgtgggaagcgcagtacggcgacttcgccaacgtcggtcagcccctgtttgacaacttcatcgtggccgcgcgatcgaagtggggggagacctccgggctggtgttgcttttgccgcacgggttcgaggggcaggcgcacgagcactcgagtggccgcgtggagcgattcctgcagctcgccgctcgcaacaacatcgtggtggcgaacgtgacgacctccgcgcagtacttccatctgctgcggcgccaggcggcacggctcaaaaacccgcgtccgctcgtcatcatgacgccgaagagcttgctcaggaacccgcttgcggcctcgaagccggaagatctgaccaacggccgatttcagccggttctgcacttcgccaagacgggggagggcgcgcaggcggttcgccgcctgattctctcgagtggcaaggtgggcgtcgatctcgccgcggagatgtcgaagcggggcgaggaggcgtgcgcgcacgtcgccaccgcgcgcgtcgagcagctgtacccgttcccggcggatcgcgtgaaggacgtcatcgcgtcgtatcccaacctgcaagaggtggtgtggctccaggaggagcccgagaaccaggggccgtggaacttcatgcggccgaggttgcaggaacttcttccggcgtcggtgaaactccgttatatcggccgtcccgagcagggctttgtcgcggaaggatcgccggacgtgcacaaccgcgtgcaggctgaaattttggcgcaggcgttggccaacgataaccattaa

SEQ ID NO: 306 - DNA, 3024 bp, Artificial
  Substituion in SEQ ID NO 291
gtgtgctttgcgcgcgaagttttgcgcgggaattccgactgtggtatacatagaaatcggaaaaggatagggtttgtcctacccgtctattcattctctgacaccaggccggaattcctgcttgggatccccgggtgtcccaaggcgccccaagcgggtgctccgtcatgcccagtgcgcgtggaagaggggttcacaatggcgaacgaacaacctggatcagtgcagacgttctggcatcagttctcagggccgaacttggcctacctgctcgagcagtatgagcagtatctcgcggatcccaacgccgtgccggaggacgtgcgcagcttattcgcgcaatacggggatccggctcaggcggtatctgcttcaccgatagagacacaaccggtgttcggacctcaggtttccgctttgtcgcctcgcacgctggaggccgcggcgaaggcccaccaattggctcaagccatccgcgcgaacggccatctcgcggcggataccgatccgctgtttgctcccgaaggttctcccgaactggaagcgtcgacgtacggccttgtggaagccgatctcgcctcattgcccgcctcggtggtgggaggccccatcgcgcagactgcgccgaccgcactcgcggccatcgaggcgctgcggaaggcgtactgcagcgacctgggctacgagtttgcccatctttcgagccgcgaagagcgggcgtggttcgaggatcagatcgaaaaccgacggttccatcagccgctcaccttggacgatgcgaaggcgctttacgagctgctggcgcgcgcgcagttgttcgagcggttcatgcacaagcgcttcgtcggccagaagcggttttccgtcgaaggtgtcgacgcgctcgttcccatggtggatgcgcttgcgaagatggcggtggacgccggtttcgatcacgtcttcatcggcatggcgcaccgcggccgcctgaatatcctcgcgcacgtgctgaagaagccctacgagcgcatcttctccgagttccacgccggcaacggcatggcctcggacgaggaactcgcggaatacatgctcggctggggcggcgacgtaaagtaccacatgggctggacgcgcaccttcgagacgccgaacggccataaggcgcgctatgtgctgtccaacaacccgagccatttggaattcgtggatcccgtcgtcgaaggcatgacgcgcgcggcgcaggacgaccgcacgcggcccgggcagcccattcaggacgtgcacaaggcgttccccattctggttcacggcgacgccgcgttcaccggcgagggtgtggtcgctgagacgctcaacttctcgaagatccccggctattacaccggcggaacggtgcacatcatcgccaataaccacctcggcttcaccgctgacccggagcagggccggtcgacgcgttacgcgagcgacattgccaagggctacgatctgccggtcgtccacgtttccgcggacaatccggaagcgtgtctgcgcgcggtgcgcctcgccttcctgtatcgcgagacgttccagaaggacatcgtgatcgatctcgtcgggtatcgccgttggggccacaacgagtcggacgatcccgccatgacgcagccggtgatgtacgcgaagatcgcctcccatccgaccgtgatggagatctacgcaaacgagctcgtcgcgcggggcgcgttcacggcggcggacctgcagaagatcgatcaggccatcgacgaggaactgctgcaggcgtacaagaagtacccggagattcacacgcctgcggccatcacggacttctcggagcccacggaggacgcaaagcccgtacccctggaggaactgaaagagatcaaccgggcgctcttggagacgccgcccgacttcacggtgtacccgaagctgaagcgcatcctggagcggcgccgggacgcgctcgacggaggcgacatcgactgggcgcatgccgaggccctggcgtttggaaccatcctgcgatccggcacgcccatccgcatgtccggccaggactcggagcgcgggacgttcggccagcgccacctcgtgctccacgacgcgaacaccaacgcgcgctacgctccgctccagcacctgccgggagccaaggcgagctttgtggtgtacaatagcccgctttcggagacggccgtgatcgggttcgaatacggctattcggtcgaagcgaaggacgcgctcgttctgtgggaagcgcagtacggcgacttcgccaacgtcggtcagcccctgtttgacaacttcatcgtggccgcgcgatcgaagtggggggagacctccgggctggtgttgcttttgccgcacgggttcgaggggcaggcgcacgagcactcgagtggccgcgtggagcgattcctgcagctcgccgctcgcaacaacatcgtggtggcgaacgtgacgacctccgcgcagtacttccatctgctgcggcgccaggcggcacggctcaaaaacccgcgtccgctcgtcatcatgacgccgaagagcttgctcaggaacccgcttgcggcctcgaagccggaagatctgaccaacggccgatttcagccggttctgcacttcgccaagacgggggagggcgcgcaggcggttcgccgcctgattctctcgagtggcaaggtgggcgtcgatctcgccgcggagatgtcgaagcggggcgaggaggcgtgcgcgcacgtcgccaccgcgcgcgtcgagcagctgtacccgttcccggcggatcgcgtgaaggacgtcatcgcgtcgtatcccaacctgcaagaggtggtgtggctccaggaggagcccgagaaccaggggccgtggaacttcatgcggccgaggttgcaggaacttcttccggcgtcggtgaaactccgttatatcggccgtcccgagcagggctttgtcgcggaaggatcgccggacgtgcacaaccgcgtgcaggctgaaattttggcgcaggcgttggccaacgataaccattaa

SEQ ID NO: 307 - protein, 549 aa, Alicyclobacillus acidocaldarius
MIYTLYGLSKSVERCGNRLISARGRSARRRMSTVWFAGRIKVRPHLHKDGIDMDGKTRSDVALIGGGIMSATLGTLFRQLAPDWTITVFERLDEVAVESSNEWNNAGTGHSALCELNYTVEQPDGSIDISKAIQVNEQFLVSRQFWSFLVRQGIIEHPRDFIVPVPHMSFVQGETNVAFLKKRHQLLSQHPLFQGMEYSEDPERLREWIPLMMKDRKLDRPIAATWIASGTDVNFGALTRMLFQYLEREGVDVQCGKEVQDLKRTRDGMWQLRVRDVKTGATYEHVSKFVFVGAGGWSLLLLQKSGIDEGKGIGGFPVSGLFMVCENPEIVRQHRAKVYGKAPVGAPPMSVPHLDSRVIGGREYVLFGPFAGFSPRFLKTGSMLDLLKSVKLHNLSTLLAAGAKNASLTLYLIRQLMLTKKQRMDELREFVPTARDEDWRLVVAGQRVQVIKRRPRGELQFGTEVVSARDGSIAALLGASPGASVVVSIMLEVIRKCFPDRLPEWENKIREMIPSYGVTLRHRPDLMRSIQAETAEVLGLHRMEARTDA

SEQ ID NO: 308 - DNA, 1650 bp, Alicyclobacillus acidocaldarius
atgatttatactctatacgggttgtcgaaatccgttgaacggtgcggaaaccgcttgatttcggcgcgcggacgttcagcgcggcgccgaatgtcgacagtttggtttgcggggcgcatcaaggtgcgcccgcatctgcataaggatgggatcgacatggacggaaagacgagatcggatgtcgccctgattggcggcggcatcatgagtgccacgctggggaccttgtttcggcagcttgcgcccgattggaccatcaccgtgttcgaacgcctcgacgaggtcgcggtggagagttcgaacgagtggaacaacgcgggcacggggcactctgcgctctgcgagctgaactacacggtcgaacagccagacggaagcatcgacatctccaaggccattcaggtgaacgagcagttcctggtctctcgccaattttggtcgttcctcgtgcgacagggcatcatcgaacatccgagagattttatcgtgcctgtgccgcacatgagcttcgtgcagggcgagacgaacgtggcgtttttgaagaaacggcaccagttgttgtcccagcacccgcttttccaagggatggaatactccgaggatcccgagcggctccgggaatggattccgctgatgatgaaggatcgcaagctggatcgcccgattgccgctacgtggatcgcgtccggcacggacgtgaacttcggcgcgctcacccggatgctgttccaatacctggagcgcgaaggcgtggacgttcagtgcggcaaagaggtccaggacttgaagcgtacgcgcgacggcatgtggcagctccgcgtgcgcgatgtgaagacgggcgccacctatgagcatgtgtcgaagttcgtcttcgtcggggccgggggatggagtctactgcttctgcagaaatccggcattgacgaggggaagggcatcggtggcttcccggtgagcggtcttttcatggtctgcgagaatcccgagattgtccgccagcaccgcgccaaggtgtatggcaaggcccccgtgggtgcgcctcccatgtccgtgccgcacctggattctcgcgtcatcggcggccgagagtatgtcctgttcgggccgttcgccgggttttcaccgcgctttttgaagacgggctccatgctcgacctactgaagtcggtcaagcttcacaacctgtcgaccctgctcgccgcgggcgccaagaacgcctcgctgacgctgtatctcatccgacagctcatgctgacgaaaaagcagcgcatggacgagctgcgcgagttcgtgcccacggcacgtgatgaggattggcgcctcgttgtcgcgggccaacgcgtccaggtcatcaagcggcgcccgcgaggcgagctgcagttcggcaccgaggtggtgagcgccagggacggatccatcgctgcgctgctcggcgcatcgccgggcgcgtcggtcgtggtgtccatcatgctcgaggtcatccgcaaatgtttcccggaccggctgcccgagtgggagaacaagatccgcgagatgatcccgtcgtacggcgtcacgctgcgccacagacccgatctgatgcgttccatccaggccgagacggccgaggtgctggggctgcatcggatggaggcccgaacggacgcgtga

SEQ ID NO: 309 - protein, 488 aa, Geobacillus thermodenitrificans NG80-2
QTKTDVILIGAGIMSATLGTLLKELAPEWDITVFERLEEAGVESSNEWNNAGTGHAALCELNYTVEKPDGSIDISKAIKINEQFYVSLQFWAYLVNSGVLRDPKEFIRPLPHMSFVQGEDNVAFLKKRYETMVNNPLFKGMEFSDDPKKLAEWIPLMMENRVVNEPIAATRIESGTDVNFGALTRKLFEHLKRKNVEIHYRHHVDDIKRTSDGLWELKVRDLDSGAVERHVAKFVFIGAGGGSLHLLQKSGIPEGRGIGGFPVSGLFMVCNNPDVVEQHHAKVYGKAKVGAPPMSVPHLDTRFINNQKMLLFGPFAGFSPKFLKNGSMLDLFTSVKPHNLLTMLAAGVKNMALTNYLIQQVMLSKEQRMEELREFVPTAKSEEWDVIVAGQRVQVIKDTEAGGKGTLQFGTEVVHAADGSIAALLGASPGASTAVHVMLEVITKCFPERMKEWEPKVREMIPSYGVSLMKNERLLHDVQAATAEMLGL

SEQ ID NO: 310 - protein, 487 aa, Geobacillus kaustophilus HTA426
KMDVILIGAGIMSATLGTLLKELAPEWDIVVFERLEEAGAESSNEWNNAGTGHAALCELNYTVEKADGSIDIGKAIKINEQFYVSLQFWAYLVNSGILRDPKDFVRPLPHMSFVQGEDNVAFLKKRHETMAANPLFKGMEFTDDPKKLAEWVPLMMEGRVVDEPIAATRIESGTDVNFGALTRQLFEHLKRKNVEIRYRHHVEDIKRTSDGLWELKVRNLDTGTVELHAAKFVFIGAGGGSLHLLQKSGIPEGKGIGGFPVSGLFMVCNNPEVVEQHHAKVYGKAKVGAPPMSVPHLDTRFIDNQKMLLFGPFAGFSPKFLKNGSMLDLFTSIKPHNVLTILAAGVKNMSLTNYLIQQVLLSKEQRMQELREFVPTAKSDEWDIVVAGQRVQVIKDTESGGKGTLQFGTEVVHAADGSIAALLGASPGASTAVHVMLEVMEKCFPERMNEWRAKVKEMIPSYGESLMKNEALLRQVQASTAEALGLN

SEQ ID NO: 311 - protein, 490 aa, Bacillus coagulans 36D1
KTDVILIGAGIMSATLGTLLKELTPDWEITVYEKLAKPAEESSNEWNNAGTGHSALCELNYTPEKPDGSIDITKAVNVNEQFQLSRQFWSYLVSKGLIHNPQDFIRPIPHMSLVEGEANVAFLKKRFKALSAHPLFEGMTFSDDPEQLKEWIPLVMEGRTSNEPIAATKSDAGTDVNFGALTRILFDHLERQDVEINYKHAVQDIQRTPEGNWEVKVHDIEHNRIEYHTAKFIFIGAGGGSLPLLQKTGIPESKHIGGFPVSGLFMVCNNPEVINRHHAKVYGKAKVGAPPMSVPHLDTRYIDHKKCLLFGPFAGFSPKFLKTGSNLDLIGSVKPNNVVTMLASGAKNVPLVKYLIGQLLLSDEKRLETLQEFIPDARLEDWDVVVAGQRVQVIKDTEAGGKGTLQFGTEVVTAADGSVAALLGASPGASTAVHVMLEVIEKCFPDRKNAWAPKIKEMIPSYGVRLAENPELLHQIHAETAETLGLTEKE

SEQ ID NO: 312 - protein, 492 aa, Bacillus halodurans C-125
QNKTDVILIGAGIMSATLGSLLKELKPEWEIKVFEKLANAGEESSNEWNNAGTGHAALCELNYTAEKSDGTIDISKAVKINEQFQISRQFWAYLVSQNLISNPQDFIMPIPHMSLVQGEDNVAYLKKRFKALSNIPLFEGMEFSNDPEKLKEWIPLVMEGRTSNEPIAATKIDSGTDVNFGALTRMLFEHLKEQNVEVHYKHSVKDIKRTSDGSWSVKVQEIESGTIEYHTANFVFIGGGGGSLPLLQKTGIPESKNIGGFPVSGLFMVCNNPEVVEQHHAKVYGKAKVGAPPMSVPHLDTRYIDNKKSLLFGPFAGFSPKFLKTGSNFDLIGSVKPYNVFTMLAAGAKEMSLTKYLIQQVMLSKEKRMAELREFMPNAKSEDWDIVVAGQRVQVIKDTEAGGKGTLQFGTEVVSSADGSIAALLGASPGASTAVHVMLEVLEKCFPHHMLEWQPKIKEMIPSYGVSLAENRELFQEIHQSTAEALGLSEKE

SEQ ID NO: 313 - protein, 490 aa, Bacillus thuringiensis str. Al Hakam
KTDVILIGAGIMSATLGSLLKELAPEWEIKVFEKLASAGEESSNEWNNAGTGHSALCELNYTSEKSDGSIDISKAVKVNEQFQLSRQFWAYLVKSKLIRNPQDFIMPLPHMSLVQGEKNVEFLKNRFEALSKNPLFQGMEFSDAPETLKKWLPLIMEGRTSNEPMAATKIDSGTDVNFGALTRMLFDYLQTKNVELNYKHSVENIKRTKNGLWEVKVHDINSGKIEHHTAKFVFIGGGGGSLPLLQKTGIPESKHIGGFPVSGLFMVCKNQKVVEQHHAKVYGKAKVGAPPMSVPHLDTRYIDNKKALLFGPFAGFSPKFLKTGSNLDLIGSVKPNNVLTMLAAGVKEMGLTKYLIQQVMLSHEKRMEELREFIPNAKSEDWDIVVAGQRVQVIKDTDAGGKGTLQFGTEVVSAADGSIAALLGASPGASTAVHVMLEVLEKCFPSRMVEWEGKIKEMIPSYGISLTENPRLFQDLHTSTGRTLGLNEKE

SEQ ID NO: 314 - protein, 549 aa, Artificial
  Substituion in SEQ ID NO 307
MIYTLYGLSKSVERCGNRIISARGRSARRRMSTVWFAGRIKVRPHLHKDGIDMDGKTRSDVALIGGGIMSATLGTLFRQLAPDWTITVFERLDEVAVESSNEWNNAGTGHSALCELNYTVEQPDGSIDISKAIQVNEQFLVSRQFWSFLVRQGIIEHPRDFIVPVPHMSFVQGETNVAFLKKRHQLLSQHPLFQGMEYSEDPERLREWIPLMMKDRKLDRPIAATWIASGTDVNFGALTRMLFQYLEREGVDVQCGKEVQDLKRTRDGMWQLRVRDVKTGATYEHVSKFVFVGAGGWSLLLLQKSGIDEGKGIGGFPVSGLFMVCENPEIVRQHRAKVYGKAPVGAPPMSVPHLDSRVIGGREYVLFGPFAGFSPRFLKTGSMLDLLKSVKLHNLSTLLAAGAKNASLTLYLIRQLMLTKKQRMDELREFVPTARDEDWRLVVAGQRVQVIKRRPRGELQFGTEVVSARDGSIAALLGASPGASVVVSIMLEVIRKCFPDRLPEWENKIREMIPSYGVTLRHRPDLMRSIQAETAEVLGLHRMEARTDA

SEQ ID NO: 315 - protein, 549 aa, Artificial
  Substituion in SEQ ID NO 307
MIYTLYGLSKSVERCGNRLISARGRSARRRMSTVWFAGRIKVRPHLHKDGIDMDGKTRSDVALIGGGIMSATLGTLFRQLAPDWTITVFERLDEVAVESSNEWNNAGTGHSALCELNYTVEQPDGSIDISKAIQVNEQFLVSRQFWSFLVRQGIIEHPRDFIVPVPHMSFVQGETNVAFLKKRHQLLSQHPLFQGMEYSEDPERLREWIPLMMKDRKLDRPIAATWIASGTDVNFGALTRMLFQYLEREGVDVQCGKEVQDLKRTKDGMWQLRVRDVKTGATYEHVSKFVFVGAGGWSLLLLQKSGIDEGKGIGGFPVSGLFMVCENPEIVRQHRAKVYGKAPVGAPPMSVPHLDSRVIGGREYVLFGPFAGFSPRFLKTGSMLDLLKSVKLHNLSTLLAAGAKNASLTLYLIRQLMLTKKQRMDELREFVPTARDEDWRLVVAGQRVQVIKRRPRGELQFGTEVVSARDGSIAALLGASPGASVVVSIMLEVIRKCFPDRLPEWENKIREMIPSYGVTLRHRPDLMRSIQAETAEVLGLHRMEARTDA

SEQ ID NO: 316 - protein, 549 aa, Artificial
  Substituion in SEQ ID NO 307
MIYTLYGLSKSVERCGNRLISARGRSARRRMSTVWFAGRIKVRPHLHKDGIDMDGKTRSDVALIGGGIMSATLGTLFRQLAPDWTITVFERLDEVAVESSNEWNNAGTGHSALCELNYTVEQPDGSIDISKAIQVNEQFLVSRQFWSFLVRQGIIEHPRDFIVPVPHMSFVQGETNVAFLKKRHQLLSQHPLFQGMDYSEDPERLREWIPLMMKDRKLDRPIAATWIASGTDVNFGALTRMLFQYLEREGVDVQCGKEVQDLKRTRDGMWQLRVRDVKTGATYEHVSKFVFVGAGGWSLLLLQKSGIDEGKGIGGFPVSGLFMVCENPEIVRQHRAKVYGKAPVGAPPMSVPHLDSRVIGGREYVLFGPFAGFSPRFLKTGSMLDLLKSVKLHNLSTLLAAGAKNASLTLYLIRQLMLTKKQRMDELREFVPTARDEDWRLVVAGQRVQVIKRRPRGELQFGTEVVSARDGSIAALLGASPGASVVVSIMLEVIRKCFPDRLPEWENKIREMIPSYGVTLRHRPDLMRSIQAETAEVLGLHRMEARTDA

SEQ ID NO: 317 - protein, 549 aa, Artificial
  Substituion in SEQ ID NO 307
MIYTLYGLSKSVERCGNRLISARGRSARRRMSTVWFAGRIKVRPHLHKDGIDMDGKTRSDVALIGGGIMSATLGTLFRQLAPDWTITVFERLDEVAVESSNEWNNAGTGHSALCELNYTVEQPDGSIDISKAIQVNEQFLVSRQFWSFLVRQGIIEHPRDFIVPVPHMSFVQGETNVAFLKKRHQLLSQHPLFQGMEYSEDPERLREWIPLMMKDRKLDRPIAATWIASGTDVNFGALTRMLFQYLEREGVDVQCGKEVQDLKRTRDGMWQLRVRDVKTGATYEHVSKFVFVGAGGWSLLLLQKSGIDEGKGIGGFPVSGLFMVCENPEIVRQHRAKVYGKAPVGAPPMSVPHLDSRIIGGREYVLFGPFAGFSPRFLKTGSMLDLLKSVKLHNLSTLLAAGAKNASLTLYLIRQLMLTKKQRMDELREFVPTARDEDWRLVVAGQRVQVIKRRPRGELQFGTEVVSARDGSIAALLGASPGASVVVSIMLEVIRKCFPDRLPEWENKIREMIPSYGVTLRHRPDLMRSIQAETAEVLGLHRMEARTDA

SEQ ID NO: 318 - protein, 549 aa, Artificial
  Substituion in SEQ ID NO 307
MIYTLYGLSKSVERCGNRLISARGRSARRRMSTVWFAGRIRVRPHLHKDGIDMDGKTRSDVALIGGGIMSATLGTLFRQLAPDWTITVFERLDEVAVESSNEWNNAGTGHSALCELNYTVEQPDGSIDISKAIQVNEQFLVSRQFWSFLVRQGIIEHPRDFIVPVPHMSFVQGETNVAFLKKRHQLLSQHPLFQGMEYSEDPERLREWIPLMMKDRKLDRPIAATWIASGTDVNFGALTRMLFQYLEREGVDVQCGKEVQDLKRTRDGMWQLRVRDVKTGATYEHVSKFVFVGAGGWSLLLLQKSGIDEGKGIGGFPVSGLFMVCENPEIVRQHRAKVYGKAPVGAPPMSVPHLDSRVIGGREYVLFGPFAGFSPRFLKTGSMLDLLKSVKLHNLSTLLAAGAKNASLTLYLIRQLMLTKKQRMDELREFVPTARDEDWRLVVAGQRVQVIKRRPRGELQFGTEVVSARDGSIAALLGASPGASVVVSIMLEVIRKCFPDRLPEWENKIREMIPSYGVTLRHRPDLMRSIQAETAEVLGLHRMEARTDA

SEQ ID NO: 319 - DNA, 1650 bp, Artificial
  Substituion in SEQ ID NO 308
atgatttatactctatacgggttgtcgaaatccgttgaacggtgcggaaaccgcattatttcggcgcgcggacgttcagcgcggcgccgaatgtcgacagtttggtttgcggggcgcatcaaggtgcgcccgcatctgcataaggatgggatcgacatggacggaaagacgagatcggatgtcgccctgattggcggcggcatcatgagtgccacgctggggaccttgtttcggcagcttgcgcccgattggaccatcaccgtgttcgaacgcctcgacgaggtcgcggtggagagttcgaacgagtggaacaacgcgggcacggggcactctgcgctctgcgagctgaactacacggtcgaacagccagacggaagcatcgacatctccaaggccattcaggtgaacgagcagttcctggtctctcgccaattttggtcgttcctcgtgcgacagggcatcatcgaacatccgagagattttatcgtgcctgtgccgcacatgagcttcgtgcagggcgagacgaacgtggcgtttttgaagaaacggcaccagttgttgtcccagcacccgcttttccaagggatggaatactccgaggatcccgagcggctccgggaatggattccgctgatgatgaaggatcgcaagctggatcgcccgattgccgctacgtggatcgcgtccggcacggacgtgaacttcggcgcgctcacccggatgctgttccaatacctggagcgcgaaggcgtggacgttcagtgcggcaaagaggtccaggacttgaagcgtacgcgcgacggcatgtggcagctccgcgtgcgcgatgtgaagacgggcgccacctatgagcatgtgtcgaagttcgtcttcgtcggggccgggggatggagtctactgcttctgcagaaatccggcattgacgaggggaagggcatcggtggcttcccggtgagcggtcttttcatggtctgcgagaatcccgagattgtccgccagcaccgcgccaaggtgtatggcaaggcccccgtgggtgcgcctcccatgtccgtgccgcacctggattctcgcgtcatcggcggccgagagtatgtcctgttcgggccgttcgccgggttttcaccgcgctttttgaagacgggctccatgctcgacctactgaagtcggtcaagcttcacaacctgtcgaccctgctcgccgcgggcgccaagaacgcctcgctgacgctgtatctcatccgacagctcatgctgacgaaaaagcagcgcatggacgagctgcgcgagttcgtgcccacggcacgtgatgaggattggcgcctcgttgtcgcgggccaacgcgtccaggtcatcaagcggcgcccgcgaggcgagctgcagttcggcaccgaggtggtgagcgccagggacggatccatcgctgcgctgctcggcgcatcgccgggcgcgtcggtcgtggtgtccatcatgctcgaggtcatccgcaaatgtttcccggaccggctgcccgagtgggagaacaagatccgcgagatgatcccgtcgtacggcgtcacgctgcgccacagacccgatctgatgcgttccatccaggccgagacggccgaggtgctggggctgcatcggatggaggcccgaacggacgcgtga

SEQ ID NO: 320 - DNA, 1650 bp, Artificial
  Substituion in SEQ ID NO 308
atgatttatactctatacgggttgtcgaaatccgttgaacggtgcggaaaccgcttgatttcggcgcgcggacgttcagcgcggcgccgaatgtcgacagtttggtttgcggggcgcatcaaggtgcgcccgcatctgcataaggatgggatcgacatggacggaaagacgagatcggatgtcgccctgattggcggcggcatcatgagtgccacgctggggaccttgtttcggcagcttgcgcccgattggaccatcaccgtgttcgaacgcctcgacgaggtcgcggtggagagttcgaacgagtggaacaacgcgggcacggggcactctgcgctctgcgagctgaactacacggtcgaacagccagacggaagcatcgacatctccaaggccattcaggtgaacgagcagttcctggtctctcgccaattttggtcgttcctcgtgcgacagggcatcatcgaacatccgagagattttatcgtgcctgtgccgcacatgagcttcgtgcagggcgagacgaacgtggcgtttttgaagaaacggcaccagttgttgtcccagcacccgcttttccaagggatggaatactccgaggatcccgagcggctccgggaatggattccgctgatgatgaaggatcgcaagctggatcgcccgattgccgctacgtggatcgcgtccggcacggacgtgaacttcggcgcgctcacccggatgctgttccaatacctggagcgcgaaggcgtggacgttcagtgcggcaaagaggtccaggacttgaagcgtacgaaagacggcatgtggcagctccgcgtgcgcgatgtgaagacgggcgccacctatgagcatgtgtcgaagttcgtcttcgtcggggccgggggatggagtctactgcttctgcagaaatccggcattgacgaggggaagggcatcggtggcttcccggtgagcggtcttttcatggtctgcgagaatcccgagattgtccgccagcaccgcgccaaggtgtatggcaaggcccccgtgggtgcgcctcccatgtccgtgccgcacctggattctcgcgtcatcggcggccgagagtatgtcctgttcgggccgttcgccgggttttcaccgcgctttttgaagacgggctccatgctcgacctactgaagtcggtcaagcttcacaacctgtcgaccctgctcgccgcgggcgccaagaacgcctcgctgacgctgtatctcatccgacagctcatgctgacgaaaaagcagcgcatggacgagctgcgcgagttcgtgcccacggcacgtgatgaggattggcgcctcgttgtcgcgggccaacgcgtccaggtcatcaagcggcgcccgcgaggcgagctgcagttcggcaccgaggtggtgagcgccagggacggatccatcgctgcgctgctcggcgcatcgccgggcgcgtcggtcgtggtgtccatcatgctcgaggtcatccgcaaatgtttcccggaccggctgcccgagtgggagaacaagatccgcgagatgatcccgtcgtacggcgtcacgctgcgccacagacccgatctgatgcgttccatccaggccgagacggccgaggtgctggggctgcatcggatggaggcccgaacggacgcgtga

SEQ ID NO: 321 - DNA, 1650 bp, Artificial
  Substituion in SEQ ID NO 308
atgatttatactctatacgggttgtcgaaatccgttgaacggtgcggaaaccgcttgatttcggcgcgcggacgttcagcgcggcgccgaatgtcgacagtttggtttgcggggcgcatcaaggtgcgcccgcatctgcataaggatgggatcgacatggacggaaagacgagatcggatgtcgccctgattggcggcggcatcatgagtgccacgctggggaccttgtttcggcagcttgcgcccgattggaccatcaccgtgttcgaacgcctcgacgaggtcgcggtggagagttcgaacgagtggaacaacgcgggcacggggcactctgcgctctgcgagctgaactacacggtcgaacagccagacggaagcatcgacatctccaaggccattcaggtgaacgagcagttcctggtctctcgccaattttggtcgttcctcgtgcgacagggcatcatcgaacatccgagagattttatcgtgcctgtgccgcacatgagcttcgtgcagggcgagacgaacgtggcgtttttgaagaaacggcaccagttgttgtcccagcacccgcttttccaagggatggattactccgaggatcccgagcggctccgggaatggattccgctgatgatgaaggatcgcaagctggatcgcccgattgccgctacgtggatcgcgtccggcacggacgtgaacttcggcgcgctcacccggatgctgttccaatacctggagcgcgaaggcgtggacgttcagtgcggcaaagaggtccaggacttgaagcgtacgcgcgacggcatgtggcagctccgcgtgcgcgatgtgaagacgggcgccacctatgagcatgtgtcgaagttcgtcttcgtcggggccgggggatggagtctactgcttctgcagaaatccggcattgacgaggggaagggcatcggtggcttcccggtgagcggtcttttcatggtctgcgagaatcccgagattgtccgccagcaccgcgccaaggtgtatggcaaggcccccgtgggtgcgcctcccatgtccgtgccgcacctggattctcgcgtcatcggcggccgagagtatgtcctgttcgggccgttcgccgggttttcaccgcgctttttgaagacgggctccatgctcgacctactgaagtcggtcaagcttcacaacctgtcgaccctgctcgccgcgggcgccaagaacgcctcgctgacgctgtatctcatccgacagctcatgctgacgaaaaagcagcgcatggacgagctgcgcgagttcgtgcccacggcacgtgatgaggattggcgcctcgttgtcgcgggccaacgcgtccaggtcatcaagcggcgcccgcgaggcgagctgcagttcggcaccgaggtggtgagcgccagggacggatccatcgctgcgctgctcggcgcatcgccgggcgcgtcggtcgtggtgtccatcatgctcgaggtcatccgcaaatgtttcccggaccggctgcccgagtgggagaacaagatccgcgagatgatcccgtcgtacggcgtcacgctgcgccacagacccgatctgatgcgttccatccaggccgagacggccgaggtgctggggctgcatcggatggaggcccgaacggacgcgtga

SEQ ID NO: 322 - DNA, 1650 bp, Artificial
  Substituion in SEQ ID NO 308
atgatttatactctatacgggttgtcgaaatccgttgaacggtgcggaaaccgcttgatttcggcgcgcggacgttcagcgcggcgccgaatgtcgacagtttggtttgcggggcgcatcaaggtgcgcccgcatctgcataaggatgggatcgacatggacggaaagacgagatcggatgtcgccctgattggcggcggcatcatgagtgccacgctggggaccttgtttcggcagcttgcgcccgattggaccatcaccgtgttcgaacgcctcgacgaggtcgcggtggagagttcgaacgagtggaacaacgcgggcacggggcactctgcgctctgcgagctgaactacacggtcgaacagccagacggaagcatcgacatctccaaggccattcaggtgaacgagcagttcctggtctctcgccaattttggtcgttcctcgtgcgacagggcatcatcgaacatccgagagattttatcgtgcctgtgccgcacatgagcttcgtgcagggcgagacgaacgtggcgtttttgaagaaacggcaccagttgttgtcccagcacccgcttttccaagggatggaatactccgaggatcccgagcggctccgggaatggattccgctgatgatgaaggatcgcaagctggatcgcccgattgccgctacgtggatcgcgtccggcacggacgtgaacttcggcgcgctcacccggatgctgttccaatacctggagcgcgaaggcgtggacgttcagtgcggcaaagaggtccaggacttgaagcgtacgcgcgacggcatgtggcagctccgcgtgcgcgatgtgaagacgggcgccacctatgagcatgtgtcgaagttcgtcttcgtcggggccgggggatggagtctactgcttctgcagaaatccggcattgacgaggggaagggcatcggtggcttcccggtgagcggtcttttcatggtctgcgagaatcccgagattgtccgccagcaccgcgccaaggtgtatggcaaggcccccgtgggtgcgcctcccatgtccgtgccgcacctggattctcgcattatcggcggccgagagtatgtcctgttcgggccgttcgccgggttttcaccgcgctttttgaagacgggctccatgctcgacctactgaagtcggtcaagcttcacaacctgtcgaccctgctcgccgcgggcgccaagaacgcctcgctgacgctgtatctcatccgacagctcatgctgacgaaaaagcagcgcatggacgagctgcgcgagttcgtgcccacggcacgtgatgaggattggcgcctcgttgtcgcgggccaacgcgtccaggtcatcaagcggcgcccgcgaggcgagctgcagttcggcaccgaggtggtgagcgccagggacggatccatcgctgcgctgctcggcgcatcgccgggcgcgtcggtcgtggtgtccatcatgctcgaggtcatccgcaaatgtttcccggaccggctgcccgagtgggagaacaagatccgcgagatgatcccgtcgtacggcgtcacgctgcgccacagacccgatctgatgcgttccatccaggccgagacggccgaggtgctggggctgcatcggatggaggcccgaacggacgcgtga

SEQ ID NO: 323 - DNA, 1650 bp, Artificial
  Substituion in SEQ ID NO 308
atgatttatactctatacgggttgtcgaaatccgttgaacggtgcggaaaccgcttgatttcggcgcgcggacgttcagcgcggcgccgaatgtcgacagtttggtttgcggggcgcatccgtgtgcgcccgcatctgcataaggatgggatcgacatggacggaaagacgagatcggatgtcgccctgattggcggcggcatcatgagtgccacgctggggaccttgtttcggcagcttgcgcccgattggaccatcaccgtgttcgaacgcctcgacgaggtcgcggtggagagttcgaacgagtggaacaacgcgggcacggggcactctgcgctctgcgagctgaactacacggtcgaacagccagacggaagcatcgacatctccaaggccattcaggtgaacgagcagttcctggtctctcgccaattttggtcgttcctcgtgcgacagggcatcatcgaacatccgagagattttatcgtgcctgtgccgcacatgagcttcgtgcagggcgagacgaacgtggcgtttttgaagaaacggcaccagttgttgtcccagcacccgcttttccaagggatggaatactccgaggatcccgagcggctccgggaatggattccgctgatgatgaaggatcgcaagctggatcgcccgattgccgctacgtggatcgcgtccggcacggacgtgaacttcggcgcgctcacccggatgctgttccaatacctggagcgcgaaggcgtggacgttcagtgcggcaaagaggtccaggacttgaagcgtacgcgcgacggcatgtggcagctccgcgtgcgcgatgtgaagacgggcgccacctatgagcatgtgtcgaagttcgtcttcgtcggggccgggggatggagtctactgcttctgcagaaatccggcattgacgaggggaagggcatcggtggcttcccggtgagcggtcttttcatggtctgcgagaatcccgagattgtccgccagcaccgcgccaaggtgtatggcaaggcccccgtgggtgcgcctcccatgtccgtgccgcacctggattctcgcgtcatcggcggccgagagtatgtcctgttcgggccgttcgccgggttttcaccgcgctttttgaagacgggctccatgctcgacctactgaagtcggtcaagcttcacaacctgtcgaccctgctcgccgcgggcgccaagaacgcctcgctgacgctgtatctcatccgacagctcatgctgacgaaaaagcagcgcatggacgagctgcgcgagttcgtgcccacggcacgtgatgaggattggcgcctcgttgtcgcgggccaacgcgtccaggtcatcaagcggcgcccgcgaggcgagctgcagttcggcaccgaggtggtgagcgccagggacggatccatcgctgcgctgctcggcgcatcgccgggcgcgtcggtcgtggtgtccatcatgctcgaggtcatccgcaaatgtttcccggaccggctgcccgagtgggagaacaagatccgcgagatgatcccgtcgtacggcgtcacgctgcgccacagacccgatctgatgcgttccatccaggccgagacggccgaggtgctggggctgcatcggatggaggcccgaacggacgcgtga

SEQ ID NO: 324 - protein, 474 aa, Alicyclobacillus acidocaldarius
MEFQRSGISLIYRLEIANKGNTFAKVASLVGNAGGDIAAVDVIRVTQDVVVRDVTINVANREHGRQIAELLDAEPGIHVVAVSDRTFLVHLGGKLEVVPKIQVKNREDLSRVYTPHVARVCEAIHEDPSKAFQLTIKRNTVAVVSDGTAVLGLGDIGPYAAMPVMEGKAMLFKQFAGVDAFPICLDTKDPDEIVETVKRIAPAFGGINLEDISSPRCFYIEERLKQELDIPVFHDDQHGTAVVMLAGLMNAAKLVGKKLQDLKVVIVGIGAAGVACTKMLLSAGVKNIIGVTLEGILHRGKQYDNEIWNWYKEHTNPDNITGTLDDAIVGADVFIGVSGPGVLTVDHIKKMAPDPIVFAMANPTPEIEPELAAPHVRVLATGRSDYPNQINNLLCFPGMFKGALAARASTINEEMKLAAAQAIASIIRENELREDYIIPSVFNQAVVQRVADAVADAARRTGVARREVMPKDNY

SEQ ID NO: 325 - DNA, 1425 bp, Alicyclobacillus acidocaldarius
atggagtttcagcggagtggcatcagtctgatttatcgactggagatcgccaataagggcaacacgtttgcgaaggtggcgagcctggtcgggaacgctggaggcgatattgctgcggtcgacgtgatccgcgtgacgcaggacgtggtggtgcgagacgtgaccatcaacgtggcgaatcgcgagcatggccgccagatcgccgagttgctcgacgcggagccggggatccacgtggtggcggtgtccgaccggaccttcctcgttcacttgggcggcaagctcgaagttgtgccgaagatccaggtgaagaaccgcgaggatctttcgcgcgtgtacacgccgcacgtggcgcgcgtgtgcgaggcgattcacgaggacccgtccaaggcgttccaactgaccatcaagcgcaacacggtggccgtggtctcggacggcacggcggtgttgggcctcggggacatcggcccgtacgcggcgatgccggtcatggaaggcaaggccatgctgttcaaacagttcgcaggcgtggacgcgttccccatctgcctcgacacgaaggatccggacgagatcgtcgagacggtgaagcgcatcgcgccggcgtttggcggcatcaatctggaggatatctcgtctccgagatgcttctatatcgaggagcggctgaagcaggagctcgacatccctgtcttccacgacgaccaacacgggacggcggtcgtcatgctggccggcctgatgaacgcggcgaagctcgtcgggaagaagcttcaggacctcaaggtcgtgatcgtcggcatcggcgctgcgggcgtggcctgcacgaaaatgctcttgtccgccggtgtgaaaaacatcatcggcgtcacgctggagggcatcctgcaccgcggcaagcagtacgacaacgagatctggaattggtacaaggagcacacgaatccggacaacatcacgggcacgctggacgacgccatcgtgggcgcggacgtgttcatcggcgtgtcgggacctggcgtgctgacggtcgatcacatcaagaagatggcgcccgatccgattgtcttcgcgatggccaacccgacgccggagatcgagccggaactggcggctccccatgtgcgcgtgctcgccaccggtcgatccgactacccgaaccagatcaacaacctcctctgtttcccgggcatgttcaagggggcgctggcggcgcgcgcgtcgaccatcaacgaggagatgaagctcgcggctgcgcaggccattgcttccatcatccgtgagaacgagttgcgcgaggactacattattccgtctgtctttaaccaagcggttgttcagcgagtcgcggacgcggtcgccgatgccgcccgccgaacgggcgtggcgcgccgcgaagtgatgccgaaggacaactattga

SEQ ID NO: 326 - protein, 438 aa, Symbiobacterium thermophilum IAM 14863
ASMRIIVRLEIENTGSIFSYIATAIGASGGDIVAVDLIQSRRDVVVRDITIAVENRAHGDRIVQALAALPGVKVVNVSDRIFLAHLGGKIEVKPRVQVKTRDDLSVVYTPGVADVCRAIAEDPAKAFTLTIKRNTVAVVTDGTAVLGLGNIGPAAALPVMEGKAMLFKQFAGVDAFPICLDTTDPDEIVRIVKAIAPAFGGINLEDISSPRCFEIEERLKEELDIPVFHDDQHGTAVVVLAGLMNAARVVGKELADLRVVVCGIGAAGVAISKMLMAAGITNIVGVDRVGIIERGKTYENPMWQWYAEHTNPENRHGTLDDAIEGADAFIGVSAPNVLKVEHVKKMAKDPIVFAMANPVPEIDPDEAAPYVAVMATGRSDYPNQVNNLLCFPGIFRGALNCRARQINEAMKLAAARAIASVVSDEELHAEYIIPSVFN

SEQ ID NO: 327 - protein, 438 aa, NAD-dependent malic enzyme (NAD-ME) gb|AAA22585.1| malic enzyme (EC 1.1.1.38) Score: 558 Significance: 1e-157 Identities: 281/438 Positives: 335/438 Gaps: 0/438
AAMNITIRLQFEKDIVSFSDIAAAIGKAGGDIVGIDVISSSKVHTVRDITVSALDTKQCDLIIEALKKIRGVKIVNVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKEFAGVDAFPICLDTKDTEEIIQIVKAIAPAFGGINLEDISAPRCFEIEKRLKEELDIPVFHDDQHGTAVVLLAGLLNALKIVDKKLEDIKVVLTGIGAAGIACTKILLAAGVRNIIGVDRHGAIHRDETYENPYWQEYAQLTNPDNLKGSLSDVIAGADVFIGVSAPGILKVEDVKKMARDPIVFAMANPIPEIDPELAEPYVRVMATGRSDYPNQINNVLCFPGIFRGALDCRAREINEEMKLAAAKAIASVVTEDELNETYIIPSVFN

SEQ ID NO: 328 - protein, 438 aa, Geobacillus kaustophilus HTA426
AAMNITIRLQFEKDIVSFSDIAAAIGKAGGDIVGIDVISSSKVHTVRDITVSALDTKQCDLIIEALKKIQGVKIINVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKEFAGVDAFPICLNTKDTEEIIQIVKAIAPAFGGINLEDISAPRCFEIEKRLKEELDIPVFHDDQHGTAVVLLAGLLNALKIVDKKLEDIKVVLTGIGAAGIACTKILLAAGVRNIIGVDRHGAIHRDETYENPYWQEYAQITNPDNLKGSLSDVIAGADVFIGVSAPGILKVEDVKKMARDPIVFAMANPIPEIDPELAEPYVRVMATGRSDYPNQINNVLCFPGIFRGALDCRAREINEEMKLAAAKAIASVVTEDELNETYIIPSVFN

SEQ ID NO: 329 - protein, 435 aa, Rubrobacter xylanophilus DSM 9941
SMTLRVEFPHRAGALGRILTTIGDAGGMVGAIDIVRMGQERSIRDITVNARDSEHGQRIVRAVGALPEVRVVNVSDRTFLLHLGGKIEVHSKIPVRTRDDLSMAYTPGVARVCRAIAQEPERAFNLTIKRNSVAVVTDGTAVLGLGDIGPYAAMPVMEGKAMLFKEFAGVDAFPVCLDTKDPEEIVRTVKYVAPAFGGINLEDISAPRCFEIEERLKQELDIPVFHDDQHGTAVVVLAALINALRIVGKRMEELKVVVCGVGAAGVACAKILLAAGVKNIVGCDRYGVVYRGRGDADTSRGWFAENTNPENIRGTLADAIRGADVFIGVSAPDVLTVEHIESMADEPIVFAMANPDPEIRPEIAYGHARIIATGRSDYPNQINNVLCFPGVFRGALDIRAREINEEMKLAAARAIAGVIPEESLSEDYIIPSVFD

SEQ ID NO: 330 - protein, 377 aa, Geobacillus thermodenitrificans NG80-2
IIEALKKIRGVKIVNVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKQFAGVDAFPVCLDTKDTEEIIQIVKAIAPAFGGINLEDISAPRCFEIEARLKEELDIPVFHDDQHGTAVVLLAGLLNALKIVDKKLEDIKVVLTGIGAAGIACTKILLAAGVRNIIGVDRYGAIHRDETYENPYWQEYAQITNPYNLKGSLSDVIVGADVFIGVSAPGILKVEDVKKMARDPIVFAMANPVPEIDPELAEPYVRVMATGRSDYPNQINNVLCFPGIFRGALDCRAKEINEEMKLAAAKAIASVVTEDELNETYIIPSVFN

SEQ ID NO: 331 - protein, 474 aa, Artificial
  Substituion in SEQ ID NO 324
MEFQRSGISLIYRLEIANKGNTFAKVASLVGNAGGDIAAVDVIRVTQDVVVRDVTINVANREHGRQIAELLDAEPGIHVVAVSDRTFLVHLGGKLEVVPKIQVKNREDLSRVYTPHVARVCEAIHEDPSKAFQLTIKRNTVAVVSDGTAVLGLGDIGPYAAMPVMEGKAMLFKQFAGVDAFPICLDTKDPDEIVETVKRIAPAFGGINLEDISSPRCFYIEERLKQELDIPVFHDDQHGTAVVMLAGLMNAAKLVGKKLQDLKVVIVGIGAAGVACTKMLLSAGVKNIIGVTLEGILHRGKQYDNEIWNWYKEHTNPDNITGTLEDAIVGADVFIGVSGPGVLTVDHIKKMAPDPIVFAMANPTPEIEPELAAPHVRVLATGRSDYPNQINNLLCFPGMFKGALAARASTINEEMKLAAAQAIASIIRENELREDYIIPSVFNQAVVQRVADAVADAARRTGVARREVMPKDNY

SEQ ID NO: 332 - protein, 474 aa, Artificial
  Substituion in SEQ ID NO 324
MEFQRSGISLIYRLEIANKGNTFAKVASLVGNAGGDIAAVDVIRVTQDVVVRDVTINVANREHGRQIAELLDAEPGIHVVAVSDRTFLVHLGGKLEVVPKIQVKNREDLSRVYTPHVARVCEAIHEDPSKAFQLTIKRNTVAVVSDGTAVLGLGDIGPYAAMPVMEGKAMLFKQFAGVDAFPICLDTKDPDEIVETVKRIAPAFGGINLEDISSPRCFYIEERLKQELDIPVFHDDQHGTAVVMLAGLMNAAKLVGKKLQDLKVVIIGIGAAGVACTKMLLSAGVKNIIGVTLEGILHRGKQYDNEIWNWYKEHTNPDNITGTLDDAIVGADVFIGVSGPGVLTVDHIKKMAPDPIVFAMANPTPEIEPELAAPHVRVLATGRSDYPNQINNLLCFPGMFKGALAARASTINEEMKLAAAQAIASIIRENELREDYIIPSVFNQAVVQRVADAVADAARRTGVARREVMPKDNY

SEQ ID NO: 333 - protein, 474 aa, Artificial
  Substituion in SEQ ID NO 324
MEFQRSGISLIYRLEIANKGNTFARVASLVGNAGGDIAAVDVIRVTQDVVVRDVTINVANREHGRQIAELLDAEPGIHVVAVSDRTFLVHLGGKLEVVPKIQVKNREDLSRVYTPHVARVCEAIHEDPSKAFQLTIKRNTVAVVSDGTAVLGLGDIGPYAAMPVMEGKAMLFKQFAGVDAFPICLDTKDPDEIVETVKRIAPAFGGINLEDISSPRCFYIEERLKQELDIPVFHDDQHGTAVVMLAGLMNAAKLVGKKLQDLKVVIVGIGAAGVACTKMLLSAGVKNIIGVTLEGILHRGKQYDNEIWNWYKEHTNPDNITGTLDDAIVGADVFIGVSGPGVLTVDHIKKMAPDPIVFAMANPTPEIEPELAAPHVRVLATGRSDYPNQINNLLCFPGMFKGALAARASTINEEMKLAAAQAIASIIRENELREDYIIPSVFNQAVVQRVADAVADAARRTGVARREVMPKDNY

SEQ ID NO: 334 - protein, 474 aa, Artificial
  Substituion in SEQ ID NO 324
MEFQRSGISLIYRLEIANKGNTFAKVASIVGNAGGDIAAVDVIRVTQDVVVRDVTINVANREHGRQIAELLDAEPGIHVVAVSDRTFLVHLGGKLEVVPKIQVKNREDLSRVYTPHVARVCEAIHEDPSKAFQLTIKRNTVAVVSDGTAVLGLGDIGPYAAMPVMEGKAMLFKQFAGVDAFPICLDTKDPDEIVETVKRIAPAFGGINLEDISSPRCFYIEERLKQELDIPVFHDDQHGTAVVMLAGLMNAAKLVGKKLQDLKVVIVGIGAAGVACTKMLLSAGVKNIIGVTLEGILHRGKQYDNEIWNWYKEHTNPDNITGTLDDAIVGADVFIGVSGPGVLTVDHIKKMAPDPIVFAMANPTPEIEPELAAPHVRVLATGRSDYPNQINNLLCFPGMFKGALAARASTINEEMKLAAAQAIASIIRENELREDYIIPSVFNQAVVQRVADAVADAARRTGVARREVMPKDNY

SEQ ID NO: 335 - protein, 474 aa, Artificial
  Substituion in SEQ ID NO 324
MEFQRSGISLIYRLEIANKGNTFAKVASLVGNAGGDIAAVDVIRVTQDVVVRDVTINVANREHGRQIAELLDAEPGIHVVAVSDRTFLVHLGGKLEVIPKIQVKNREDLSRVYTPHVARVCEAIHEDPSKAFQLTIKRNTVAVVSDGTAVLGLGDIGPYAAMPVMEGKAMLFKQFAGVDAFPICLDTKDPDEIVETVKRIAPAFGGINLEDISSPRCFYIEERLKQELDIPVFHDDQHGTAVVMLAGLMNAAKLVGKKLQDLKVVIVGIGAAGVACTKMLLSAGVKNIIGVTLEGILHRGKQYDNEIWNWYKEHTNPDNITGTLDDAIVGADVFIGVSGPGVLTVDHIKKMAPDPIVFAMANPTPEIEPELAAPHVRVLATGRSDYPNQINNLLCFPGMFKGALAARASTINEEMKLAAAQAIASIIRENELREDYIIPSVFNQAVVQRVADAVADAARRTGVARREVMPKDNY

SEQ ID NO: 336 - DNA, 1425 bp, Artificial
  Substituion in SEQ ID NO 325
atggagtttcagcggagtggcatcagtctgatttatcgactggagatcgccaataagggcaacacgtttgcgaaggtggcgagcctggtcgggaacgctggaggcgatattgctgcggtcgacgtgatccgcgtgacgcaggacgtggtggtgcgagacgtgaccatcaacgtggcgaatcgcgagcatggccgccagatcgccgagttgctcgacgcggagccggggatccacgtggtggcggtgtccgaccggaccttcctcgttcacttgggcggcaagctcgaagttgtgccgaagatccaggtgaagaaccgcgaggatctttcgcgcgtgtacacgccgcacgtggcgcgcgtgtgcgaggcgattcacgaggacccgtccaaggcgttccaactgaccatcaagcgcaacacggtggccgtggtctcggacggcacggcggtgttgggcctcggggacatcggcccgtacgcggcgatgccggtcatggaaggcaaggccatgctgttcaaacagttcgcaggcgtggacgcgttccccatctgcctcgacacgaaggatccggacgagatcgtcgagacggtgaagcgcatcgcgccggcgtttggcggcatcaatctggaggatatctcgtctccgagatgcttctatatcgaggagcggctgaagcaggagctcgacatccctgtcttccacgacgaccaacacgggacggcggtcgtcatgctggccggcctgatgaacgcggcgaagctcgtcgggaagaagcttcaggacctcaaggtcgtgatcgtcggcatcggcgctgcgggcgtggcctgcacgaaaatgctcttgtccgccggtgtgaaaaacatcatcggcgtcacgctggagggcatcctgcaccgcggcaagcagtacgacaacgagatctggaattggtacaaggagcacacgaatccggacaacatcacgggcacgctggaagacgccatcgtgggcgcggacgtgttcatcggcgtgtcgggacctggcgtgctgacggtcgatcacatcaagaagatggcgcccgatccgattgtcttcgcgatggccaacccgacgccggagatcgagccggaactggcggctccccatgtgcgcgtgctcgccaccggtcgatccgactacccgaaccagatcaacaacctcctctgtttcccgggcatgttcaagggggcgctggcggcgcgcgcgtcgaccatcaacgaggagatgaagctcgcggctgcgcaggccattgcttccatcatccgtgagaacgagttgcgcgaggactacattattccgtctgtctttaaccaagcggttgttcagcgagtcgcggacgcggtcgccgatgccgcccgccgaacgggcgtggcgcgccgcgaagtgatgccgaaggacaactattga

SEQ ID NO: 337 - DNA, 1425 bp, Artificial
  Substituion in SEQ ID NO 325
atggagtttcagcggagtggcatcagtctgatttatcgactggagatcgccaataagggcaacacgtttgcgaaggtggcgagcctggtcgggaacgctggaggcgatattgctgcggtcgacgtgatccgcgtgacgcaggacgtggtggtgcgagacgtgaccatcaacgtggcgaatcgcgagcatggccgccagatcgccgagttgctcgacgcggagccggggatccacgtggtggcggtgtccgaccggaccttcctcgttcacttgggcggcaagctcgaagttgtgccgaagatccaggtgaagaaccgcgaggatctttcgcgcgtgtacacgccgcacgtggcgcgcgtgtgcgaggcgattcacgaggacccgtccaaggcgttccaactgaccatcaagcgcaacacggtggccgtggtctcggacggcacggcggtgttgggcctcggggacatcggcccgtacgcggcgatgccggtcatggaaggcaaggccatgctgttcaaacagttcgcaggcgtggacgcgttccccatctgcctcgacacgaaggatccggacgagatcgtcgagacggtgaagcgcatcgcgccggcgtttggcggcatcaatctggaggatatctcgtctccgagatgcttctatatcgaggagcggctgaagcaggagctcgacatccctgtcttccacgacgaccaacacgggacggcggtcgtcatgctggccggcctgatgaacgcggcgaagctcgtcgggaagaagcttcaggacctcaaggtcgtgatcattggcatcggcgctgcgggcgtggcctgcacgaaaatgctcttgtccgccggtgtgaaaaacatcatcggcgtcacgctggagggcatcctgcaccgcggcaagcagtacgacaacgagatctggaattggtacaaggagcacacgaatccggacaacatcacgggcacgctggacgacgccatcgtgggcgcggacgtgttcatcggcgtgtcgggacctggcgtgctgacggtcgatcacatcaagaagatggcgcccgatccgattgtcttcgcgatggccaacccgacgccggagatcgagccggaactggcggctccccatgtgcgcgtgctcgccaccggtcgatccgactacccgaaccagatcaacaacctcctctgtttcccgggcatgttcaagggggcgctggcggcgcgcgcgtcgaccatcaacgaggagatgaagctcgcggctgcgcaggccattgcttccatcatccgtgagaacgagttgcgcgaggactacattattccgtctgtctttaaccaagcggttgttcagcgagtcgcggacgcggtcgccgatgccgcccgccgaacgggcgtggcgcgccgcgaagtgatgccgaaggacaactattga

SEQ ID NO: 338 - DNA, 1425 bp, Artificial
  Substituion in SEQ ID NO 325
atggagtttcagcggagtggcatcagtctgatttatcgactggagatcgccaataagggcaacacgtttgcgcgtgtggcgagcctggtcgggaacgctggaggcgatattgctgcggtcgacgtgatccgcgtgacgcaggacgtggtggtgcgagacgtgaccatcaacgtggcgaatcgcgagcatggccgccagatcgccgagttgctcgacgcggagccggggatccacgtggtggcggtgtccgaccggaccttcctcgttcacttgggcggcaagctcgaagttgtgccgaagatccaggtgaagaaccgcgaggatctttcgcgcgtgtacacgccgcacgtggcgcgcgtgtgcgaggcgattcacgaggacccgtccaaggcgttccaactgaccatcaagcgcaacacggtggccgtggtctcggacggcacggcggtgttgggcctcggggacatcggcccgtacgcggcgatgccggtcatggaaggcaaggccatgctgttcaaacagttcgcaggcgtggacgcgttccccatctgcctcgacacgaaggatccggacgagatcgtcgagacggtgaagcgcatcgcgccggcgtttggcggcatcaatctggaggatatctcgtctccgagatgcttctatatcgaggagcggctgaagcaggagctcgacatccctgtcttccacgacgaccaacacgggacggcggtcgtcatgctggccggcctgatgaacgcggcgaagctcgtcgggaagaagcttcaggacctcaaggtcgtgatcgtcggcatcggcgctgcgggcgtggcctgcacgaaaatgctcttgtccgccggtgtgaaaaacatcatcggcgtcacgctggagggcatcctgcaccgcggcaagcagtacgacaacgagatctggaattggtacaaggagcacacgaatccggacaacatcacgggcacgctggacgacgccatcgtgggcgcggacgtgttcatcggcgtgtcgggacctggcgtgctgacggtcgatcacatcaagaagatggcgcccgatccgattgtcttcgcgatggccaacccgacgccggagatcgagccggaactggcggctccccatgtgcgcgtgctcgccaccggtcgatccgactacccgaaccagatcaacaacctcctctgtttcccgggcatgttcaagggggcgctggcggcgcgcgcgtcgaccatcaacgaggagatgaagctcgcggctgcgcaggccattgcttccatcatccgtgagaacgagttgcgcgaggactacattattccgtctgtctttaaccaagcggttgttcagcgagtcgcggacgcggtcgccgatgccgcccgccgaacgggcgtggcgcgccgcgaagtgatgccgaaggacaactattga

SEQ ID NO: 339 - DNA, 1425 bp, Artificial
  Substituion in SEQ ID NO 325
atggagtttcagcggagtggcatcagtctgatttatcgactggagatcgccaataagggcaacacgtttgcgaaggtggcgagcattgtcgggaacgctggaggcgatattgctgcggtcgacgtgatccgcgtgacgcaggacgtggtggtgcgagacgtgaccatcaacgtggcgaatcgcgagcatggccgccagatcgccgagttgctcgacgcggagccggggatccacgtggtggcggtgtccgaccggaccttcctcgttcacttgggcggcaagctcgaagttgtgccgaagatccaggtgaagaaccgcgaggatctttcgcgcgtgtacacgccgcacgtggcgcgcgtgtgcgaggcgattcacgaggacccgtccaaggcgttccaactgaccatcaagcgcaacacggtggccgtggtctcggacggcacggcggtgttgggcctcggggacatcggcccgtacgcggcgatgccggtcatggaaggcaaggccatgctgttcaaacagttcgcaggcgtggacgcgttccccatctgcctcgacacgaaggatccggacgagatcgtcgagacggtgaagcgcatcgcgccggcgtttggcggcatcaatctggaggatatctcgtctccgagatgcttctatatcgaggagcggctgaagcaggagctcgacatccctgtcttccacgacgaccaacacgggacggcggtcgtcatgctggccggcctgatgaacgcggcgaagctcgtcgggaagaagcttcaggacctcaaggtcgtgatcgtcggcatcggcgctgcgggcgtggcctgcacgaaaatgctcttgtccgccggtgtgaaaaacatcatcggcgtcacgctggagggcatcctgcaccgcggcaagcagtacgacaacgagatctggaattggtacaaggagcacacgaatccggacaacatcacgggcacgctggacgacgccatcgtgggcgcggacgtgttcatcggcgtgtcgggacctggcgtgctgacggtcgatcacatcaagaagatggcgcccgatccgattgtcttcgcgatggccaacccgacgccggagatcgagccggaactggcggctccccatgtgcgcgtgctcgccaccggtcgatccgactacccgaaccagatcaacaacctcctctgtttcccgggcatgttcaagggggcgctggcggcgcgcgcgtcgaccatcaacgaggagatgaagctcgcggctgcgcaggccattgcttccatcatccgtgagaacgagttgcgcgaggactacattattccgtctgtctttaaccaagcggttgttcagcgagtcgcggacgcggtcgccgatgccgcccgccgaacgggcgtggcgcgccgcgaagtgatgccgaaggacaactattga

SEQ ID NO: 340 - DNA, 1425 bp, Artificial
  Substituion in SEQ ID NO 325
atggagtttcagcggagtggcatcagtctgatttatcgactggagatcgccaataagggcaacacgtttgcgaaggtggcgagcctggtcgggaacgctggaggcgatattgctgcggtcgacgtgatccgcgtgacgcaggacgtggtggtgcgagacgtgaccatcaacgtggcgaatcgcgagcatggccgccagatcgccgagttgctcgacgcggagccggggatccacgtggtggcggtgtccgaccggaccttcctcgttcacttgggcggcaagctcgaagttattccgaagatccaggtgaagaaccgcgaggatctttcgcgcgtgtacacgccgcacgtggcgcgcgtgtgcgaggcgattcacgaggacccgtccaaggcgttccaactgaccatcaagcgcaacacggtggccgtggtctcggacggcacggcggtgttgggcctcggggacatcggcccgtacgcggcgatgccggtcatggaaggcaaggccatgctgttcaaacagttcgcaggcgtggacgcgttccccatctgcctcgacacgaaggatccggacgagatcgtcgagacggtgaagcgcatcgcgccggcgtttggcggcatcaatctggaggatatctcgtctccgagatgcttctatatcgaggagcggctgaagcaggagctcgacatccctgtcttccacgacgaccaacacgggacggcggtcgtcatgctggccggcctgatgaacgcggcgaagctcgtcgggaagaagcttcaggacctcaaggtcgtgatcgtcggcatcggcgctgcgggcgtggcctgcacgaaaatgctcttgtccgccggtgtgaaaaacatcatcggcgtcacgctggagggcatcctgcaccgcggcaagcagtacgacaacgagatctggaattggtacaaggagcacacgaatccggacaacatcacgggcacgctggacgacgccatcgtgggcgcggacgtgttcatcggcgtgtcgggacctggcgtgctgacggtcgatcacatcaagaagatggcgcccgatccgattgtcttcgcgatggccaacccgacgccggagatcgagccggaactggcggctccccatgtgcgcgtgctcgccaccggtcgatccgactacccgaaccagatcaacaacctcctctgtttcccgggcatgttcaagggggcgctggcggcgcgcgcgtcgaccatcaacgaggagatgaagctcgcggctgcgcaggccattgcttccatcatccgtgagaacgagttgcgcgaggactacattattccgtctgtctttaaccaagcggttgttcagcgagtcgcggacgcggtcgccgatgccgcccgccgaacgggcgtggcgcgccgcgaagtgatgccgaaggacaactattga

SEQ ID NO: 341 - protein, 906 aa, Alicyclobacillus acidocaldarius
MANDAPLHRDIRVLGDLLGEVLVEQCGRRVFDHVESIRLAAKAFRADPSPETRAALQAAVSAVEPEHRNDVIHAFSVYFQLVNLAEQNHRLRRHRDYDRSQQVLRGSFRETMRTLADRGMTADDIESLLREVGIELVLTAHPTEALRRTVLDKHTKIAAFLEDMDDPRKTPRELDVLRERIRTEIVALWQTRSVRKQRITVLDEVRNGLYFLDQILFDVLPRVHQKLEQAVEEQFGRQLLELPPLIRFGSWMGGDRDGNPNVTSDITWQTLVLHCDLALNKYEQKLRELGRDLSVSVDRAGADEDLLASLGGENDEPYRALINRMLERLANTRRRLHGERVDGPDYASPEAMMEDVERMARSLAHHRGQRMVDAWLRPFLLQLRIFGFHMVTLDIRQHSGVHEQAVAELLQTAGLVDDYTSLGEEERVRVLSECLASPRPIRNPYHVYSDVTTEALAVLDCVRRGHETFGPRCVQDYLISMTQGASDLLEVLLLAKESGLFGWPDGPMAPPKSDLNVVPLFETIEDLESAAGIMRSLFENPVYRRHLEMRGWQQEIMLGYSDSNKDGGYLTANWSLYMAQKHLIRLAEAYGVRIKFFHGRGGALGRGGGPVEQSILAQPTEALRGHVKITEQGEVISQRYGHPGIAERSLESSAAAVLVGATREDSEEWAERHPRWFRLLDRASEISFRAYRKLVFEHPAFLEYFHRATPIDEIGKMNIGSRPSRRSQSARIEDLRAIPWVFSWTQSRHLLPAWYGFGSAIEAIMREDPRALEDLRRMYEVWPFFRTLVDNLQMALAKADMLVAKEYAQLAGEAGEAVFPLIEEEYARTERAVLDITGYRQLLDNRPVIRESISLRNPYVDPLSFFQVRLLADLRTDNLSPEEREAELADALQTINGIAAGLRNTG

SEQ ID NO: 342 - DNA, 2721 bp, Alicyclobacillus acidocaldarius
ttggcgaacgacgcacccttgcaccgggacatacgcgtcctcggggatttgttgggagaagtgctggtcgagcagtgcggccggcgcgtcttcgatcacgtcgaatccattcgcctcgctgccaaggcctttcgcgcggacccgtcgcccgaaacgcgcgcggcgctgcaggcggccgtgtccgccgtggagcccgagcaccggaacgacgtgattcacgcgttttcggtctactttcagttggtcaacctcgcggagcaaaaccacaggcttcgccgccaccgagattacgatcgctcgcaacaggtgctgcgcgggtcgtttcgcgaaaccatgcgcaccctggccgatcgcggcatgaccgccgacgacattgagtccctgcttcgggaggtcgggatcgagctcgtgctcaccgcgcatcccaccgaggcgctgcgccgcaccgtgctcgacaaacacacgaagatcgcggctttcctcgaggacatggacgatccgcgcaagacgccgagagagctcgacgtgctgcgcgagcgaattcgcaccgagatcgtcgcgctgtggcaaacgagatcggtgcgcaagcagcgcatcaccgtgctggatgaggtccgaaacgggctgtactttctggaccagatcctgttcgacgtccttcctcgcgtgcatcaaaagctcgaacaggcggtcgaggaacagtttggtcgtcagcttctcgaactgcccccgcttattcgcttcggctcgtggatggggggcgatcgcgacggcaatccgaacgtcacgtccgacatcacctggcagacgctcgtcctccactgcgatctcgccctcaacaaatatgagcaaaagttgcgagaactcgggcgcgatctgagcgtgtccgtggaccgggcgggcgcggacgaggatctcctggcttccctgggaggcgaaaacgacgagccgtaccgggcgctcatcaaccggatgctggagcggctcgccaacacgcggcgccggctgcacggggagcgggtggacggtcccgattacgcgtcacccgaagcgatgatggaggacgtcgaacggatggcgagatcgctcgcgcatcaccggggccagcgcatggtggatgcgtggttgcgcccgttcctgctgcagcttcgcatcttcggcttccacatggtgacgctcgacatccgtcagcactccggcgttcatgagcaggcggtggcggagctcttgcagacggcgggcctcgtggacgactacacgtcgcttggcgaggaagagcgcgtgcgcgtcctgtccgaatgccttgcgtcgccgcgccccattcgcaatccgtatcacgtgtactccgatgtcaccacggaggcgctcgcggtcctcgactgcgtgcggcgagggcacgagaccttcgggcctcgctgcgtgcaggactacctcatttccatgacgcaaggcgcgagcgacctgcttgaggtgttgctcttggcgaaggagtccggcttgttcggctggccggacgggccgatggcgccgcccaagagcgacttgaacgtcgttccgctgtttgagaccatcgaggacctggagtccgcggcggggatcatgcggtcgctgtttgaaaaccccgtgtatcggcgtcacctggagatgcgcggctggcagcaggagatcatgctcgggtattccgacagcaacaaggacggcggctatctcaccgccaactggtcgctgtacatggctcaaaagcacctgattcgcctggcggaagcgtacggcgtgcgcatcaagttctttcacggccggggcggcgcgctggggcgagggggcggtcccgtggagcagagcattctcgcccagcccacggaggcgctccgagggcacgtgaagatcacggagcagggcgaggtcatctcgcagcggtatggacacccgggcatcgccgaacgctcgcttgagtcctcggcggcggctgtgctggtgggcgccacgcgagaggacagcgaggagtgggcagagcgccatccgaggtggtttcggcttttggaccgagcgtcggaaatcagcttccgcgcctaccggaagctggtcttcgagcatcccgcgttcctcgagtatttccatcgggcgacgcccattgacgagatcggcaagatgaacattgggtcgaggccttcgcggcgctcgcagtcggcgcgaatcgaggacctgcgggccatcccctgggtgttctcgtggacgcagagccgccacctgctgcccgcctggtacggcttcggcagtgcgatagaggccatcatgcgggaggaccctcgcgcgcttgaagaccttcgccgcatgtacgaggtgtggccgttcttccggacgctggtcgacaatcttcagatggcgctcgccaaggcggatatgctcgtggcgaaggaatacgcgcagttggcgggggaggcgggagaggccgtctttccgctgattgaggaggagtacgcgcgcacggagcgcgccgtgctcgacatcacgggctaccggcagcttctcgacaacaggccggtcatacgggagtccatctcgcttcgcaacccgtatgtcgatccgctgtcgttcttccaggtgcgcctgttggccgatctgcgcacggacaacctgtcgcccgaagagcgcgaggcggagctggccgacgcgctgcagaccattaacggcatcgccgcgggcctgcgcaataccggctga

SEQ ID NO: 343 - protein, 886 aa, Bacillus coagulans 36D1
GEALLKTIQNIRSLAQKARETGDEAFYLQLKKEITDLNPPERQEVIRAFSTYLQLFNITEQNFRIKRRREYQSEDTDQVQPRSLEDGIETLRKEKVPAEMVAELLNSLSLELIITAHPTEATRRTILQIHKRIADLLKALEYANTRYEKKVIEETILNEITILWQSSEIREKKPSVLDEVKNGLYYFDNVLFDVLPRIHEDLEDYLHESYGQRFKVPSYLHFGSWIGGDRDGNPNVTADITWKTLEMQRELVLEKYKKSLTTLRELLSHSSKKISASHALLASVESEENTMPAAKLWPTKDEIYRRKLTIMIHKLECVGKNNGGYQSAKELLADLYMIRDSVNQHHPAGHPIKLLRKVIRQVELFGFHLASLDIRNHSGEHESALAEVLYNVNIAKDYKNLSEDEKVAVLLKALNDPRPMISIYDTFTPETQEVINTFRMIKRAHQTFGERSIQVYLISMAHSVSDVLEVLVLAKEAGLYRVYPSGDILSEIHIAPLLETIADLRNGAKMLETLFQMPIYRNHLKVRGNLQEVMLGYSDGSKDGGTMTANWQLYKAQKEIHEMGAKYGIKLKFFHGRGGSLGRGGGPLYSSLLSQPPVTLGDGVKITEQGEVLSSRYLLRDIAYRSLEQATSTMMCAITEQKQNEKNGKTPNEEAVRAMDKISEYALEKYQELVFRDPDFLSYFKQATPLNEIGELNIGSRPMSRKGSARFEDLRAIPWVFSWTQSRQLLPAWYAAGTGLSKYVEETGNFKLLQEMYASWPFFHATINNLQMALIKAELSTAEEYTRLVKDPEVAGRIFGLIKAEYELTKEMVLKIADQKELLDYTPNIKESVRLRNPYVDPLNLFQVYLISQLRERENKDEKARHLLMEVLLTINGIAAGLRNTG

SEQ ID NO: 344 - protein, 890 aa, Bacillus selenitireducens MLS10
GEALFNEVEEIREMTKALRKSYDEANEKELKKRIENLKSPMRQQVIRAFAIYFHLVNIAEQHHRIRRSRQYRMKRGENIQPSSIEAAIVNIQKEKYPETVIQQVLDDSSIELIMTAHPTEATKRTILEIQKRISYILEQFDNPALTEKEREDHEESLINEVTALWHTDELRFKKPTVIDEVKNGLYYFDTTLFDVLPAVHQEIEEQLERYYPDQDFKVPNFIHFGSWIGGDRDGNPFVTPEVTWETLNLQRDLTLRKYEESITELMRRFSQSTTRVDIDPEFIETMEQYEKKYMKKSETWPVTTEIYRRMLGAIRKRIRQVGKTNTGYDVAEELLADLRYVRENALKHQLPNQKLKQLNKMIRQVELFGFHLATLDVRNHSGEHETAIAEILKVVGITEDYKSLDEEEKMTILENALKDPRPLMLLNEDYSEETREIFKVFQMIKDAHEEFGQRSIEVYLVSMTQSASDLLEVLVLAKEAGIYRLHADGSVDSNLHVAPLLETVDDLMAGPAIMKRLFEMDIYRTHLGERGDHQEIMLGYSDGSKDGGTLTANWKLFEAQAKIHNMAKDYNVRLKFFHGRGGSLGRGGGPLNRSIVSQPAETLGDGVKITEQGEVLSSRYLLGDIAFRNLEQAASALLEASANVYASPGDSCHIRRPQWEEAMEEISKASLSKYQSLVFKDPDFLTYFKETTPLNELKELNIGSRPMSRKGSERFEDLRAIPWVFAWTQCRQMLPAWYASGTGLAAYGKASEENLELLQDMYQNWPFFHSTINNLQMALMKADLFAAKEYVKLVKDQEMGQRIYGEIEKEFNLTKEMLLKISGSEQLLDFTPNIRDSVHLRNPYVDPLNFLQVDLIEKMRESSSEERTEELLTEVLLTISGVAAGLLNTG

SEQ ID NO: 345 - protein, 912 aa, Dechloromonas aromatica RCB
SKDEPLRTDIRLLGRILGDTVREQEGESVFDIVERVRQTAVRFARDGDPAARDELAALLDPLPGDTTQAVVRAFSYFLQLANIAEDEHHIRRRRAHDLAGSPPREGSLIFALDALSTAAVSPEAIADFFAHAVVAPVLTAHPTEVQRQSLIRNHRDLAHLLDQRERLQMTPEEEAENDLALANAILTLWQSRMLRPVRLKVLDEVKNGITYFKETFFTELPRLYIQATEQLQKRYPEKTWALPPFFRVGSWIGGDRDGNPFVTADILREALRLQSSAALNHYLNEVHELGGELPLSDLLVKVTPELLALAEHSTDHSPQRADEPYRRALSGIYARLAATARALDQFEPVRHEIGHATPYDTPDALRADLKLLANSLKLNGSAKLAGGRLRRLLRGVQIFGFHLAPIDLRQNSDVHARSVAELLAGAGRCPDYEALSEAERIKLLVDEISTPRPLYSPYLNYSEETQGELAIFFAARELRQKYGSAALPNCIISKTDGVSDLLELALLLKESGLLLPGAKPQLKVNIIPLFETIEDLQKSAATMAGVFAIPAYRELIAGRGDEHEVMLGYSDSNKDGGFLTSGWELYKAEIELARIFGQHGVRLRLFHGRGGSVGRGGGPTYHAILAQPAGAVAGQIRLTEQGEVISTKYGNADTGRRNLEVLLAATLEASLTDHENRVEPAEQFHAVMDELSARAFNAYRGLVYETPGFTTYFRQSTVVSEIASLNIGSRPASRKASERIEDLRAIPWVFSWAQCRLMLPGWYGFGAAVEGYLQANPAGLATLRRMVHAWPFFKSLLSNMDMVLAKTDLAIASRYAELVADVELREHIFSRIKAEWALTRQHLLAILEQDEFLADNPLLARSLQLRSPYMDPLNHLQVELLKRHRAGDTDERLARGIHLTINGIASGLRNSG

SEQ ID NO: 346 - protein, 901 aa, Herpetosiphon aurantiacus ATCC 23779
QDGVSAFELEEDVRQRTKQRRSDGTLQETQTLTELISQLPVAQLMGLIKAFTHYFGLVNLAESVERLRVLAERDRQNGDAPRSESVELALQELRDRGITAQQVQDLLDHAEIRPVFTAHPTEAKRRTTLKKHHRIAGAARQLTADTTFQRQRERLLESIREEVISLWQSDEVRIIKPTVIDEVKNNLYYFEESLFDMIPQLYRDTEASLRQIYPEHEWRVPAFLRFGSWVGGDRDGNPFVIPSVTVETLKLLMGRSLREHIHSVERLSHRLSQSSRQVPISEELAQSLIHDAPLFPELAQVLERRNPHEPYRQKCSYIHAKLHATLAYVERYEPDWARGGHRPAEGTWYANANQYLADLATMEYSLRTNGAASVADGFLRDIQCSAKVFGLHTATLDIRQHSSRHTNALSEIFEYAGICDDYASLSQAERTAVLERELANNRPLIPTHLYYSPETVEIIETFRTIRAVLSDLNAEAIETYIISMTEGPSDILAVLLLAREAGIYQPGEHSWLNIVPLFETGADLIAAPEIMHTLLSSEAYRQHLVLRNDVQEIMLGYSDSNKDGGFADAHWALYLAQVALAETCFRHRVAMRLFHGRGGAVGRGGGPANRAILGQPPGTVGGRIKITEQGEVISDRYAEPETAYRHQEQIINAVLRSSLGVSIAHISQEWHDAMSSLAKVSRKVYRGLVYDHPHFLEYFRNATPITEISRLNIGSRPASRKASDRIEDLRAIPWVFSWMQSRHTLPGWYGLGSALEHLIQADANGLTTLQGMYNDWPFFRTMLDNAQMILSKADMDIAAQYALLVPDQALANEIFGLIKAEYTRTVKWICEVAQINELLDTSPILQHSIKQRNPYVDPLSFVQIELLRRLRTDPDGLEHSDLEDAILLSINGIAAGLKNTG

SEQ ID NO: 347 - protein, 923 aa, Roseiflexus sp. RS-1
QAGEEAFRLVEQLRTLGKELRNGEPDRADASLRALASQMTVTDVQTVIKAFNAYFLLVNLAEQMQRVWILRDREQASPTAPRTESIAAAIAEIHAHNVSAVTVQEWLETARIQPVFTAHPTEARRRTALEKVRRLATLLDRRSGGLQGFELEENTLRIREEIVSLWQTDEVRVVKPTVIDEVKNGLFYFESGLFDLIPRLYRELEYALRTAYPDHEWRVPPLLRYGAWMGGDRDGNPNVTHAVTLQTVRLLRAAAVQRHITTIEELSHRLGQSTRQAPVSEELRASLANDAALFPDVADMLTQRNPYELYRQKCTYIREKLLRTLNDANTASLDWGRSDPPPNGAYLRSDDLLADLRVMEQSLRANNAAVVADGALRDLIRQVEVFGLHTATLDIRQHSERHTAALAEVLASAGVCADYTALNETERIDLLSREIGNPRPLIPAHLDYSPDTVEVIQTFRTIAAILNRLSPEAIETYIVSMTRGASDLLAPLLLAKEAGLFRPFRFSRLNIAPLFETGADLTCCDTILEACLSLPVYRDHLALRGNLQEVMIGYSDSNKDVGYVAANWALYQAQRKLRDFGRRYGIHMRLFHGRGGAIGRGGGPANHAILAQPPGSIGNQIKITEQGEVIADRYGLPLLAHRHIEQVMNAVLRAGLLQRDDPPAEWMQALERLADLSQRHYRALVYERNDFVPYFHNVTPITEISRLNIGSRPASRRNTGRIEDLRAIPWVFSWMQSRHTLPGWYGMGFALETFVYKGDGIDLDMSGDSGNVTGDGTTDHVGSAIDRLALLQEMYARWSFFRVMIDNAQMILGKADLHIAARYAELAPDREAAASIFAAIRDEYGRTDRMIRQIARIERLLDNSPVLQHSIQRRNPYIDPMSYLQIELLRRLRAAPDGPQHAAIEDAILLSISGLAAGLMNTG

SEQ ID NO: 348 - protein, 906 aa, Artificial
  Substituion in SEQ ID NO 341
MANDAPLHRDIRVLGDLLGEVLVEQCGRRVFDHVESIRLAAKAFRADPSPETRAALQAAVSAVEPEHRNDVIHAFSVYFQLVNLAEQNHRLRRHRDYDRSQQVLRGSFRETMRTLADRGMTADDIESLLREVGIELVLTAHPTEALRRTVLDKHTKIAAFLEDMDDPRKTPRELDVLRERIRTEIVALWQTRSVRKQRITVLDEVRNGLYFLDQILFDVLPRVHQKLEQAVEEQFGRQLLELPPLIRFGSWMGGDRDGNPNVTSDITWQTLVLHCDLALNKYEQKLRELGRDLSVSVDRAGADEDLLASLGGENDEPYRALINRMLERLANTRRRLHGERVDGPDYASPEAMMEDVERMARSLAHHRGQRMVDAWLRPFLLQLRIFGFHMVTLDIRQHSGVHEQAVAELLQTAGLVDDYTSLGEDERVRVLSECLASPRPIRNPYHVYSDVTTEALAVLDCVRRGHETFGPRCVQDYLISMTQGASDLLEVLLLAKESGLFGWPDGPMAPPKSDLNVVPLFETIEDLESAAGIMRSLFENPVYRRHLEMRGWQQEIMLGYSDSNKDGGYLTANWSLYMAQKHLIRLAEAYGVRIKFFHGRGGALGRGGGPVEQSILAQPTEALRGHVKITEQGEVISQRYGHPGIAERSLESSAAAVLVGATREDSEEWAERHPRWFRLLDRASEISFRAYRKLVFEHPAFLEYFHRATPIDEIGKMNIGSRPSRRSQSARIEDLRAIPWVFSWTQSRHLLPAWYGFGSAIEAIMREDPRALEDLRRMYEVWPFFRTLVDNLQMALAKADMLVAKEYAQLAGEAGEAVFPLIEEEYARTERAVLDITGYRQLLDNRPVIRESISLRNPYVDPLSFFQVRLLADLRTDNLSPEEREAELADALQTINGIAAGLRNTG

SEQ ID NO: 349 - protein, 906 aa, Artificial
  Substituion in SEQ ID NO 341
MANDAPLHRDIRVLGDLLGEVLVEQCGRRVFDHVESIRLAAKAFRADPSPETRAALQAAVSAVEPEHRNDVIHAFSVYFQLVNLAEQNHRLRRHRDYDRSQQILRGSFRETMRTLADRGMTADDIESLLREVGIELVLTAHPTEALRRTVLDKHTKIAAFLEDMDDPRKTPRELDVLRERIRTEIVALWQTRSVRKQRITVLDEVRNGLYFLDQILFDVLPRVHQKLEQAVEEQFGRQLLELPPLIRFGSWMGGDRDGNPNVTSDITWQTLVLHCDLALNKYEQKLRELGRDLSVSVDRAGADEDLLASLGGENDEPYRALINRMLERLANTRRRLHGERVDGPDYASPEAMMEDVERMARSLAHHRGQRMVDAWLRPFLLQLRIFGFHMVTLDIRQHSGVHEQAVAELLQTAGLVDDYTSLGEEERVRVLSECLASPRPIRNPYHVYSDVTTEALAVLDCVRRGHETFGPRCVQDYLISMTQGASDLLEVLLLAKESGLFGWPDGPMAPPKSDLNVVPLFETIEDLESAAGIMRSLFENPVYRRHLEMRGWQQEIMLGYSDSNKDGGYLTANWSLYMAQKHLIRLAEAYGVRIKFFHGRGGALGRGGGPVEQSILAQPTEALRGHVKITEQGEVISQRYGHPGIAERSLESSAAAVLVGATREDSEEWAERHPRWFRLLDRASEISFRAYRKLVFEHPAFLEYFHRATPIDEIGKMNIGSRPSRRSQSARIEDLRAIPWVFSWTQSRHLLPAWYGFGSAIEAIMREDPRALEDLRRMYEVWPFFRTLVDNLQMALAKADMLVAKEYAQLAGEAGEAVFPLIEEEYARTERAVLDITGYRQLLDNRPVIRESISLRNPYVDPLSFFQVRLLADLRTDNLSPEEREAELADALQTINGIAAGLRNTG

SEQ ID NO: 350 - protein, 906 aa, Artificial
  Substituion in SEQ ID NO 341
MANDAPLHRDIRVLGDLLGEVLVEQCGKRVFDHVESIRLAAKAFRADPSPETRAALQAAVSAVEPEHRNDVIHAFSVYFQLVNLAEQNHRLRRHRDYDRSQQVLRGSFRETMRTLADRGMTADDIESLLREVGIELVLTAHPTEALRRTVLDKHTKIAAFLEDMDDPRKTPRELDVLRERIRTEIVALWQTRSVRKQRITVLDEVRNGLYFLDQILFDVLPRVHQKLEQAVEEQFGRQLLELPPLIRFGSWMGGDRDGNPNVTSDITWQTLVLHCDLALNKYEQKLRELGRDLSVSVDRAGADEDLLASLGGENDEPYRALINRMLERLANTRRRLHGERVDGPDYASPEAMMEDVERMARSLAHHRGQRMVDAWLRPFLLQLRIFGFHMVTLDIRQHSGVHEQAVAELLQTAGLVDDYTSLGEEERVRVLSECLASPRPIRNPYHVYSDVTTEALAVLDCVRRGHETFGPRCVQDYLISMTQGASDLLEVLLLAKESGLFGWPDGPMAPPKSDLNVVPLFETIEDLESAAGIMRSLFENPVYRRHLEMRGWQQEIMLGYSDSNKDGGYLTANWSLYMAQKHLIRLAEAYGVRIKFFHGRGGALGRGGGPVEQSILAQPTEALRGHVKITEQGEVISQRYGHPGIAERSLESSAAAVLVGATREDSEEWAERHPRWFRLLDRASEISFRAYRKLVFEHPAFLEYFHRATPIDEIGKMNIGSRPSRRSQSARIEDLRAIPWVFSWTQSRHLLPAWYGFGSAIEAIMREDPRALEDLRRMYEVWPFFRTLVDNLQMALAKADMLVAKEYAQLAGEAGEAVFPLIEEEYARTERAVLDITGYRQLLDNRPVIRESISLRNPYVDPLSFFQVRLLADLRTDNLSPEEREAELADALQTINGIAAGLRNTG

SEQ ID NO: 351 - protein, 906 aa, Artificial
  Substituion in SEQ ID NO 341
MANDAPLHRDIRVLGDLLGEVLVEQCGRRVFDHVESIRLAAKAFRADPSPETRAALQAAVSAVEPEHRNDVIHAFSVYFQLVNLAEQNHRLRRHRDYDRSQQVLRGSFRETMRTLADRGMTADDIESLLREVGIELVLTAHPTEALRRTVLDKHTKIAAFLEDMDDPRKTPRELDVLRERIRTEIVALWQTRSVRKQRITVLDEVRNGLYFLDQILFDVLPRVHQKLEQAVEEQFGRQLLELPPLIRFGSWMGGDRDGNPNVTSDITWQTLVLHCDLALNKYEQKLRDLGRDLSVSVDRAGADEDLLASLGGENDEPYRALINRMLERLANTRRRLHGERVDGPDYASPEAMMEDVERMARSLAHHRGQRMVDAWLRPFLLQLRIFGFHMVTLDIRQHSGVHEQAVAELLQTAGLVDDYTSLGEEERVRVLSECLASPRPIRNPYHVYSDVTTEALAVLDCVRRGHETFGPRCVQDYLISMTQGASDLLEVLLLAKESGLFGWPDGPMAPPKSDLNVVPLFETIEDLESAAGIMRSLFENPVYRRHLEMRGWQQEIMLGYSDSNKDGGYLTANWSLYMAQKHLIRLAEAYGVRIKFFHGRGGALGRGGGPVEQSILAQPTEALRGHVKITEQGEVISQRYGHPGIAERSLESSAAAVLVGATREDSEEWAERHPRWFRLLDRASEISFRAYRKLVFEHPAFLEYFHRATPIDEIGKMNIGSRPSRRSQSARIEDLRAIPWVFSWTQSRHLLPAWYGFGSAIEAIMREDPRALEDLRRMYEVWPFFRTLVDNLQMALAKADMLVAKEYAQLAGEAGEAVFPLIEEEYARTERAVLDITGYRQLLDNRPVIRESISLRNPYVDPLSFFQVRLLADLRTDNLSPEEREAELADALQTINGIAAGLRNTG

SEQ ID NO: 352 - protein, 906 aa, Artificial
  Substituion in SEQ ID NO 341
MANDAPLHRDIRVLGDLLGEVLVEQCGRRVFDHVESIRLAAKAFRADPSPETRAALQAAVSAVEPEHRNDVIHAFSVYFQLVNLAEQNHRLRRHRDYDRSQQVLRGSFRETMRTLADRGMTADDIESLLREVGIELVLTAHPTEALRRTVLDKHTKIAAFLEDMDDPRKTPRELDVLRERIRTEIVALWQTRSVRKQRITVLDEVRNGLYFLDQILFDVLPRVHQKLEQAVEEQFGRQLLELPPLIRFGSWMGGDRDGNPNVTSDITWQTLVLHCDLALNKYEQKLRELGRDLSVSVDRAGADEDLLASLGGENDEPYRALINRMLERLANTRRRLHGERVDGPDYASPEAMMEDVERMARSLAHHRGQRMVDAWLRPFLLQLRIFGFHMVTLDIRQHSGVHEQAVAELLQTAGLVDDYTSLGEEERVRVLSECLASPRPIRNPYHVYSDVTTEALAVLDCVRRGHETFGPRCVQDYLISMTQGASDLLEVLLLAKESGLFGWPDGPMAPPKSDLNVVPLFETIEDLESAAGIMRSLFENPVYRRHLEMRGWQQEIMLGYSDSNKDGGYLTANWSLYMAQKHLIRLAEAYGVRIKFFHGRGGALGRGGGPVEQSILAQPTEALRGHVKITEQGEVISQRYGHPGIAERSLESSAAAVLVGATREDSEEWAERHPRWFRLLDRASEISFRAYRKLVFEHPAFLEYFHRATPIDEIGKMNIGSRPSRRSQSARIEDLRAIPWVFSWTQSRHLLPAWYGFGSAIEAIMREDPRALDDLRRMYEVWPFFRTLVDNLQMALAKADMLVAKEYAQLAGEAGEAVFPLIEEEYARTERAVLDITGYRQLLDNRPVIRESISLRNPYVDPLSFFQVRLLADLRTDNLSPEEREAELADALQTINGIAAGLRNTG

SEQ ID NO: 353 - DNA, 2721 bp, Artificial
  Substituion in SEQ ID NO 342
ttggcgaacgacgcacccttgcaccgggacatacgcgtcctcggggatttgttgggagaagtgctggtcgagcagtgcggccggcgcgtcttcgatcacgtcgaatccattcgcctcgctgccaaggcctttcgcgcggacccgtcgcccgaaacgcgcgcggcgctgcaggcggccgtgtccgccgtggagcccgagcaccggaacgacgtgattcacgcgttttcggtctactttcagttggtcaacctcgcggagcaaaaccacaggcttcgccgccaccgagattacgatcgctcgcaacaggtgctgcgcgggtcgtttcgcgaaaccatgcgcaccctggccgatcgcggcatgaccgccgacgacattgagtccctgcttcgggaggtcgggatcgagctcgtgctcaccgcgcatcccaccgaggcgctgcgccgcaccgtgctcgacaaacacacgaagatcgcggctttcctcgaggacatggacgatccgcgcaagacgccgagagagctcgacgtgctgcgcgagcgaattcgcaccgagatcgtcgcgctgtggcaaacgagatcggtgcgcaagcagcgcatcaccgtgctggatgaggtccgaaacgggctgtactttctggaccagatcctgttcgacgtccttcctcgcgtgcatcaaaagctcgaacaggcggtcgaggaacagtttggtcgtcagcttctcgaactgcccccgcttattcgcttcggctcgtggatggggggcgatcgcgacggcaatccgaacgtcacgtccgacatcacctggcagacgctcgtcctccactgcgatctcgccctcaacaaatatgagcaaaagttgcgagaactcgggcgcgatctgagcgtgtccgtggaccgggcgggcgcggacgaggatctcctggcttccctgggaggcgaaaacgacgagccgtaccgggcgctcatcaaccggatgctggagcggctcgccaacacgcggcgccggctgcacggggagcgggtggacggtcccgattacgcgtcacccgaagcgatgatggaggacgtcgaacggatggcgagatcgctcgcgcatcaccggggccagcgcatggtggatgcgtggttgcgcccgttcctgctgcagcttcgcatcttcggcttccacatggtgacgctcgacatccgtcagcactccggcgttcatgagcaggcggtggcggagctcttgcagacggcgggcctcgtggacgactacacgtcgcttggcgaggatgagcgcgtgcgcgtcctgtccgaatgccttgcgtcgccgcgccccattcgcaatccgtatcacgtgtactccgatgtcaccacggaggcgctcgcggtcctcgactgcgtgcggcgagggcacgagaccttcgggcctcgctgcgtgcaggactacctcatttccatgacgcaaggcgcgagcgacctgcttgaggtgttgctcttggcgaaggagtccggcttgttcggctggccggacgggccgatggcgccgcccaagagcgacttgaacgtcgttccgctgtttgagaccatcgaggacctggagtccgcggcggggatcatgcggtcgctgtttgaaaaccccgtgtatcggcgtcacctggagatgcgcggctggcagcaggagatcatgctcgggtattccgacagcaacaaggacggcggctatctcaccgccaactggtcgctgtacatggctcaaaagcacctgattcgcctggcggaagcgtacggcgtgcgcatcaagttctttcacggccggggcggcgcgctggggcgagggggcggtcccgtggagcagagcattctcgcccagcccacggaggcgctccgagggcacgtgaagatcacggagcagggcgaggtcatctcgcagcggtatggacacccgggcatcgccgaacgctcgcttgagtcctcggcggcggctgtgctggtgggcgccacgcgagaggacagcgaggagtgggcagagcgccatccgaggtggtttcggcttttggaccgagcgtcggaaatcagcttccgcgcctaccggaagctggtcttcgagcatcccgcgttcctcgagtatttccatcgggcgacgcccattgacgagatcggcaagatgaacattgggtcgaggccttcgcggcgctcgcagtcggcgcgaatcgaggacctgcgggccatcccctgggtgttctcgtggacgcagagccgccacctgctgcccgcctggtacggcttcggcagtgcgatagaggccatcatgcgggaggaccctcgcgcgcttgaagaccttcgccgcatgtacgaggtgtggccgttcttccggacgctggtcgacaatcttcagatggcgctcgccaaggcggatatgctcgtggcgaaggaatacgcgcagttggcgggggaggcgggagaggccgtctttccgctgattgaggaggagtacgcgcgcacggagcgcgccgtgctcgacatcacgggctaccggcagcttctcgacaacaggccggtcatacgggagtccatctcgcttcgcaacccgtatgtcgatccgctgtcgttcttccaggtgcgcctgttggccgatctgcgcacggacaacctgtcgcccgaagagcgcgaggcggagctggccgacgcgctgcagaccattaacggcatcgccgcgggcctgcgcaataccggctga

SEQ ID NO: 354 - DNA, 2721 bp, Artificial
  Substituion in SEQ ID NO 342
ttggcgaacgacgcacccttgcaccgggacatacgcgtcctcggggatttgttgggagaagtgctggtcgagcagtgcggccggcgcgtcttcgatcacgtcgaatccattcgcctcgctgccaaggcctttcgcgcggacccgtcgcccgaaacgcgcgcggcgctgcaggcggccgtgtccgccgtggagcccgagcaccggaacgacgtgattcacgcgttttcggtctactttcagttggtcaacctcgcggagcaaaaccacaggcttcgccgccaccgagattacgatcgctcgcaacagattctgcgcgggtcgtttcgcgaaaccatgcgcaccctggccgatcgcggcatgaccgccgacgacattgagtccctgcttcgggaggtcgggatcgagctcgtgctcaccgcgcatcccaccgaggcgctgcgccgcaccgtgctcgacaaacacacgaagatcgcggctttcctcgaggacatggacgatccgcgcaagacgccgagagagctcgacgtgctgcgcgagcgaattcgcaccgagatcgtcgcgctgtggcaaacgagatcggtgcgcaagcagcgcatcaccgtgctggatgaggtccgaaacgggctgtactttctggaccagatcctgttcgacgtccttcctcgcgtgcatcaaaagctcgaacaggcggtcgaggaacagtttggtcgtcagcttctcgaactgcccccgcttattcgcttcggctcgtggatggggggcgatcgcgacggcaatccgaacgtcacgtccgacatcacctggcagacgctcgtcctccactgcgatctcgccctcaacaaatatgagcaaaagttgcgagaactcgggcgcgatctgagcgtgtccgtggaccgggcgggcgcggacgaggatctcctggcttccctgggaggcgaaaacgacgagccgtaccgggcgctcatcaaccggatgctggagcggctcgccaacacgcggcgccggctgcacggggagcgggtggacggtcccgattacgcgtcacccgaagcgatgatggaggacgtcgaacggatggcgagatcgctcgcgcatcaccggggccagcgcatggtggatgcgtggttgcgcccgttcctgctgcagcttcgcatcttcggcttccacatggtgacgctcgacatccgtcagcactccggcgttcatgagcaggcggtggcggagctcttgcagacggcgggcctcgtggacgactacacgtcgcttggcgaggaagagcgcgtgcgcgtcctgtccgaatgccttgcgtcgccgcgccccattcgcaatccgtatcacgtgtactccgatgtcaccacggaggcgctcgcggtcctcgactgcgtgcggcgagggcacgagaccttcgggcctcgctgcgtgcaggactacctcatttccatgacgcaaggcgcgagcgacctgcttgaggtgttgctcttggcgaaggagtccggcttgttcggctggccggacgggccgatggcgccgcccaagagcgacttgaacgtcgttccgctgtttgagaccatcgaggacctggagtccgcggcggggatcatgcggtcgctgtttgaaaaccccgtgtatcggcgtcacctggagatgcgcggctggcagcaggagatcatgctcgggtattccgacagcaacaaggacggcggctatctcaccgccaactggtcgctgtacatggctcaaaagcacctgattcgcctggcggaagcgtacggcgtgcgcatcaagttctttcacggccggggcggcgcgctggggcgagggggcggtcccgtggagcagagcattctcgcccagcccacggaggcgctccgagggcacgtgaagatcacggagcagggcgaggtcatctcgcagcggtatggacacccgggcatcgccgaacgctcgcttgagtcctcggcggcggctgtgctggtgggcgccacgcgagaggacagcgaggagtgggcagagcgccatccgaggtggtttcggcttttggaccgagcgtcggaaatcagcttccgcgcctaccggaagctggtcttcgagcatcccgcgttcctcgagtatttccatcgggcgacgcccattgacgagatcggcaagatgaacattgggtcgaggccttcgcggcgctcgcagtcggcgcgaatcgaggacctgcgggccatcccctgggtgttctcgtggacgcagagccgccacctgctgcccgcctggtacggcttcggcagtgcgatagaggccatcatgcgggaggaccctcgcgcgcttgaagaccttcgccgcatgtacgaggtgtggccgttcttccggacgctggtcgacaatcttcagatggcgctcgccaaggcggatatgctcgtggcgaaggaatacgcgcagttggcgggggaggcgggagaggccgtctttccgctgattgaggaggagtacgcgcgcacggagcgcgccgtgctcgacatcacgggctaccggcagcttctcgacaacaggccggtcatacgggagtccatctcgcttcgcaacccgtatgtcgatccgctgtcgttcttccaggtgcgcctgttggccgatctgcgcacggacaacctgtcgcccgaagagcgcgaggcggagctggccgacgcgctgcagaccattaacggcatcgccgcgggcctgcgcaataccggctga

SEQ ID NO: 355 - DNA, 2721 bp, Artificial
  Substituion in SEQ ID NO 342
ttggcgaacgacgcacccttgcaccgggacatacgcgtcctcggggatttgttgggagaagtgctggtcgagcagtgcggcaaacgcgtcttcgatcacgtcgaatccattcgcctcgctgccaaggcctttcgcgcggacccgtcgcccgaaacgcgcgcggcgctgcaggcggccgtgtccgccgtggagcccgagcaccggaacgacgtgattcacgcgttttcggtctactttcagttggtcaacctcgcggagcaaaaccacaggcttcgccgccaccgagattacgatcgctcgcaacaggtgctgcgcgggtcgtttcgcgaaaccatgcgcaccctggccgatcgcggcatgaccgccgacgacattgagtccctgcttcgggaggtcgggatcgagctcgtgctcaccgcgcatcccaccgaggcgctgcgccgcaccgtgctcgacaaacacacgaagatcgcggctttcctcgaggacatggacgatccgcgcaagacgccgagagagctcgacgtgctgcgcgagcgaattcgcaccgagatcgtcgcgctgtggcaaacgagatcggtgcgcaagcagcgcatcaccgtgctggatgaggtccgaaacgggctgtactttctggaccagatcctgttcgacgtccttcctcgcgtgcatcaaaagctcgaacaggcggtcgaggaacagtttggtcgtcagcttctcgaactgcccccgcttattcgcttcggctcgtggatggggggcgatcgcgacggcaatccgaacgtcacgtccgacatcacctggcagacgctcgtcctccactgcgatctcgccctcaacaaatatgagcaaaagttgcgagaactcgggcgcgatctgagcgtgtccgtggaccgggcgggcgcggacgaggatctcctggcttccctgggaggcgaaaacgacgagccgtaccgggcgctcatcaaccggatgctggagcggctcgccaacacgcggcgccggctgcacggggagcgggtggacggtcccgattacgcgtcacccgaagcgatgatggaggacgtcgaacggatggcgagatcgctcgcgcatcaccggggccagcgcatggtggatgcgtggttgcgcccgttcctgctgcagcttcgcatcttcggcttccacatggtgacgctcgacatccgtcagcactccggcgttcatgagcaggcggtggcggagctcttgcagacggcgggcctcgtggacgactacacgtcgcttggcgaggaagagcgcgtgcgcgtcctgtccgaatgccttgcgtcgccgcgccccattcgcaatccgtatcacgtgtactccgatgtcaccacggaggcgctcgcggtcctcgactgcgtgcggcgagggcacgagaccttcgggcctcgctgcgtgcaggactacctcatttccatgacgcaaggcgcgagcgacctgcttgaggtgttgctcttggcgaaggagtccggcttgttcggctggccggacgggccgatggcgccgcccaagagcgacttgaacgtcgttccgctgtttgagaccatcgaggacctggagtccgcggcggggatcatgcggtcgctgtttgaaaaccccgtgtatcggcgtcacctggagatgcgcggctggcagcaggagatcatgctcgggtattccgacagcaacaaggacggcggctatctcaccgccaactggtcgctgtacatggctcaaaagcacctgattcgcctggcggaagcgtacggcgtgcgcatcaagttctttcacggccggggcggcgcgctggggcgagggggcggtcccgtggagcagagcattctcgcccagcccacggaggcgctccgagggcacgtgaagatcacggagcagggcgaggtcatctcgcagcggtatggacacccgggcatcgccgaacgctcgcttgagtcctcggcggcggctgtgctggtgggcgccacgcgagaggacagcgaggagtgggcagagcgccatccgaggtggtttcggcttttggaccgagcgtcggaaatcagcttccgcgcctaccggaagctggtcttcgagcatcccgcgttcctcgagtatttccatcgggcgacgcccattgacgagatcggcaagatgaacattgggtcgaggccttcgcggcgctcgcagtcggcgcgaatcgaggacctgcgggccatcccctgggtgttctcgtggacgcagagccgccacctgctgcccgcctggtacggcttcggcagtgcgatagaggccatcatgcgggaggaccctcgcgcgcttgaagaccttcgccgcatgtacgaggtgtggccgttcttccggacgctggtcgacaatcttcagatggcgctcgccaaggcggatatgctcgtggcgaaggaatacgcgcagttggcgggggaggcgggagaggccgtctttccgctgattgaggaggagtacgcgcgcacggagcgcgccgtgctcgacatcacgggctaccggcagcttctcgacaacaggccggtcatacgggagtccatctcgcttcgcaacccgtatgtcgatccgctgtcgttcttccaggtgcgcctgttggccgatctgcgcacggacaacctgtcgcccgaagagcgcgaggcggagctggccgacgcgctgcagaccattaacggcatcgccgcgggcctgcgcaataccggctga

SEQ ID NO: 356 - DNA, 2721 bp, Artificial
  Substituion in SEQ ID NO 342
ttggcgaacgacgcacccttgcaccgggacatacgcgtcctcggggatttgttgggagaagtgctggtcgagcagtgcggccggcgcgtcttcgatcacgtcgaatccattcgcctcgctgccaaggcctttcgcgcggacccgtcgcccgaaacgcgcgcggcgctgcaggcggccgtgtccgccgtggagcccgagcaccggaacgacgtgattcacgcgttttcggtctactttcagttggtcaacctcgcggagcaaaaccacaggcttcgccgccaccgagattacgatcgctcgcaacaggtgctgcgcgggtcgtttcgcgaaaccatgcgcaccctggccgatcgcggcatgaccgccgacgacattgagtccctgcttcgggaggtcgggatcgagctcgtgctcaccgcgcatcccaccgaggcgctgcgccgcaccgtgctcgacaaacacacgaagatcgcggctttcctcgaggacatggacgatccgcgcaagacgccgagagagctcgacgtgctgcgcgagcgaattcgcaccgagatcgtcgcgctgtggcaaacgagatcggtgcgcaagcagcgcatcaccgtgctggatgaggtccgaaacgggctgtactttctggaccagatcctgttcgacgtccttcctcgcgtgcatcaaaagctcgaacaggcggtcgaggaacagtttggtcgtcagcttctcgaactgcccccgcttattcgcttcggctcgtggatggggggcgatcgcgacggcaatccgaacgtcacgtccgacatcacctggcagacgctcgtcctccactgcgatctcgccctcaacaaatatgagcaaaagttgcgagatctcgggcgcgatctgagcgtgtccgtggaccgggcgggcgcggacgaggatctcctggcttccctgggaggcgaaaacgacgagccgtaccgggcgctcatcaaccggatgctggagcggctcgccaacacgcggcgccggctgcacggggagcgggtggacggtcccgattacgcgtcacccgaagcgatgatggaggacgtcgaacggatggcgagatcgctcgcgcatcaccggggccagcgcatggtggatgcgtggttgcgcccgttcctgctgcagcttcgcatcttcggcttccacatggtgacgctcgacatccgtcagcactccggcgttcatgagcaggcggtggcggagctcttgcagacggcgggcctcgtggacgactacacgtcgcttggcgaggaagagcgcgtgcgcgtcctgtccgaatgccttgcgtcgccgcgccccattcgcaatccgtatcacgtgtactccgatgtcaccacggaggcgctcgcggtcctcgactgcgtgcggcgagggcacgagaccttcgggcctcgctgcgtgcaggactacctcatttccatgacgcaaggcgcgagcgacctgcttgaggtgttgctcttggcgaaggagtccggcttgttcggctggccggacgggccgatggcgccgcccaagagcgacttgaacgtcgttccgctgtttgagaccatcgaggacctggagtccgcggcggggatcatgcggtcgctgtttgaaaaccccgtgtatcggcgtcacctggagatgcgcggctggcagcaggagatcatgctcgggtattccgacagcaacaaggacggcggctatctcaccgccaactggtcgctgtacatggctcaaaagcacctgattcgcctggcggaagcgtacggcgtgcgcatcaagttctttcacggccggggcggcgcgctggggcgagggggcggtcccgtggagcagagcattctcgcccagcccacggaggcgctccgagggcacgtgaagatcacggagcagggcgaggtcatctcgcagcggtatggacacccgggcatcgccgaacgctcgcttgagtcctcggcggcggctgtgctggtgggcgccacgcgagaggacagcgaggagtgggcagagcgccatccgaggtggtttcggcttttggaccgagcgtcggaaatcagcttccgcgcctaccggaagctggtcttcgagcatcccgcgttcctcgagtatttccatcgggcgacgcccattgacgagatcggcaagatgaacattgggtcgaggccttcgcggcgctcgcagtcggcgcgaatcgaggacctgcgggccatcccctgggtgttctcgtggacgcagagccgccacctgctgcccgcctggtacggcttcggcagtgcgatagaggccatcatgcgggaggaccctcgcgcgcttgaagaccttcgccgcatgtacgaggtgtggccgttcttccggacgctggtcgacaatcttcagatggcgctcgccaaggcggatatgctcgtggcgaaggaatacgcgcagttggcgggggaggcgggagaggccgtctttccgctgattgaggaggagtacgcgcgcacggagcgcgccgtgctcgacatcacgggctaccggcagcttctcgacaacaggccggtcatacgggagtccatctcgcttcgcaacccgtatgtcgatccgctgtcgttcttccaggtgcgcctgttggccgatctgcgcacggacaacctgtcgcccgaagagcgcgaggcggagctggccgacgcgctgcagaccattaacggcatcgccgcgggcctgcgcaataccggctga

SEQ ID NO: 357 - DNA, 2721 bp, Artificial
  Substituion in SEQ ID NO 342
ttggcgaacgacgcacccttgcaccgggacatacgcgtcctcggggatttgttgggagaagtgctggtcgagcagtgcggccggcgcgtcttcgatcacgtcgaatccattcgcctcgctgccaaggcctttcgcgcggacccgtcgcccgaaacgcgcgcggcgctgcaggcggccgtgtccgccgtggagcccgagcaccggaacgacgtgattcacgcgttttcggtctactttcagttggtcaacctcgcggagcaaaaccacaggcttcgccgccaccgagattacgatcgctcgcaacaggtgctgcgcgggtcgtttcgcgaaaccatgcgcaccctggccgatcgcggcatgaccgccgacgacattgagtccctgcttcgggaggtcgggatcgagctcgtgctcaccgcgcatcccaccgaggcgctgcgccgcaccgtgctcgacaaacacacgaagatcgcggctttcctcgaggacatggacgatccgcgcaagacgccgagagagctcgacgtgctgcgcgagcgaattcgcaccgagatcgtcgcgctgtggcaaacgagatcggtgcgcaagcagcgcatcaccgtgctggatgaggtccgaaacgggctgtactttctggaccagatcctgttcgacgtccttcctcgcgtgcatcaaaagctcgaacaggcggtcgaggaacagtttggtcgtcagcttctcgaactgcccccgcttattcgcttcggctcgtggatggggggcgatcgcgacggcaatccgaacgtcacgtccgacatcacctggcagacgctcgtcctccactgcgatctcgccctcaacaaatatgagcaaaagttgcgagaactcgggcgcgatctgagcgtgtccgtggaccgggcgggcgcggacgaggatctcctggcttccctgggaggcgaaaacgacgagccgtaccgggcgctcatcaaccggatgctggagcggctcgccaacacgcggcgccggctgcacggggagcgggtggacggtcccgattacgcgtcacccgaagcgatgatggaggacgtcgaacggatggcgagatcgctcgcgcatcaccggggccagcgcatggtggatgcgtggttgcgcccgttcctgctgcagcttcgcatcttcggcttccacatggtgacgctcgacatccgtcagcactccggcgttcatgagcaggcggtggcggagctcttgcagacggcgggcctcgtggacgactacacgtcgcttggcgaggaagagcgcgtgcgcgtcctgtccgaatgccttgcgtcgccgcgccccattcgcaatccgtatcacgtgtactccgatgtcaccacggaggcgctcgcggtcctcgactgcgtgcggcgagggcacgagaccttcgggcctcgctgcgtgcaggactacctcatttccatgacgcaaggcgcgagcgacctgcttgaggtgttgctcttggcgaaggagtccggcttgttcggctggccggacgggccgatggcgccgcccaagagcgacttgaacgtcgttccgctgtttgagaccatcgaggacctggagtccgcggcggggatcatgcggtcgctgtttgaaaaccccgtgtatcggcgtcacctggagatgcgcggctggcagcaggagatcatgctcgggtattccgacagcaacaaggacggcggctatctcaccgccaactggtcgctgtacatggctcaaaagcacctgattcgcctggcggaagcgtacggcgtgcgcatcaagttctttcacggccggggcggcgcgctggggcgagggggcggtcccgtggagcagagcattctcgcccagcccacggaggcgctccgagggcacgtgaagatcacggagcagggcgaggtcatctcgcagcggtatggacacccgggcatcgccgaacgctcgcttgagtcctcggcggcggctgtgctggtgggcgccacgcgagaggacagcgaggagtgggcagagcgccatccgaggtggtttcggcttttggaccgagcgtcggaaatcagcttccgcgcctaccggaagctggtcttcgagcatcccgcgttcctcgagtatttccatcgggcgacgcccattgacgagatcggcaagatgaacattgggtcgaggccttcgcggcgctcgcagtcggcgcgaatcgaggacctgcgggccatcccctgggtgttctcgtggacgcagagccgccacctgctgcccgcctggtacggcttcggcagtgcgatagaggccatcatgcgggaggaccctcgcgcgcttgatgaccttcgccgcatgtacgaggtgtggccgttcttccggacgctggtcgacaatcttcagatggcgctcgccaaggcggatatgctcgtggcgaaggaatacgcgcagttggcgggggaggcgggagaggccgtctttccgctgattgaggaggagtacgcgcgcacggagcgcgccgtgctcgacatcacgggctaccggcagcttctcgacaacaggccggtcatacgggagtccatctcgcttcgcaacccgtatgtcgatccgctgtcgttcttccaggtgcgcctgttggccgatctgcgcacggacaacctgtcgcccgaagagcgcgaggcggagctggccgacgcgctgcagaccattaacggcatcgccgcgggcctgcgcaataccggctga

SEQ ID NO: 358 - protein, 251 aa, Alicyclobacillus acidocaldarius
MHHGASRLGRMGVRFMRSNKVYESAGAAIADIPNGATLLVGGFGLCGIPMALIQALRDRGVSDLVCVSNNCGVDDWGLGILLQTRQIRKMVSSYVGENKTFERQFLNGELEVELVPQGTLAERIRAGGAGIPAFYTATGVGTSVAEGKEVRTFDGREYVLERAITGDFALIKGWKADKLGNVIYHETERNFNPVMATAAKVTIVEVEELVEPGELDPNFIHTPSIYVHRIVVNPNPIKRIERRTVRPRPQA

SEQ ID NO: 359 - DNA, 756 bp, Alicyclobacillus acidocaldarius
atgcaccacggcgcgtcgcgtcttggtcgaatgggagtgaggtttatgcgttccaacaaggtgtacgagtcggcgggggccgcaatcgcggacattcccaacggcgccacgctgctcgtcggcggcttcgggctgtgcggcattcccatggcgctcatccaggccctgcgagatcggggcgtgtccgatctggtctgcgtcagcaacaactgcggcgtggacgactggggcctcgggatcttgcttcagacgcggcagatccgcaagatggtctcctcgtacgtcggggagaacaagacgttcgagcgccagtttctgaacggcgaactcgaggtggagttggttccccaagggacgctggccgagcgcatccgcgccggcggcgcgggcatcccggcgttctacaccgccacaggggtcggcacctccgtcgccgagggcaaggaagtgcggacgttcgacggacgcgagtacgtcctcgaacgagccatcactggggattttgcactcatcaagggttggaaggccgacaagctcggcaacgtcatctatcacgagacggagcgcaacttcaatccggtcatggcgacggccgccaaggtcaccatcgtcgaggtggaggagcttgtggagccaggcgaattggatcccaacttcattcatacgccaagcatttacgtgcatcggattgtcgtgaatccgaaccccatcaagcggatcgagcggagaaccgtccgcccgcgtccgcaggcttga

SEQ ID NO: 360 - protein, 231 aa, Exiguobacterium sibiricum 255-15
MQQGKIYDSFTEATADIFDGATLVVGGFGLCGIPEKSIAALQEQGVKELTVVSNNCGVDDFGLGILLQSRQIKKMVSSYVGENKTFEQQYLSGEIEVDLVPQGTLAERIRAGGAGIPGFYTPTGVGTPIAEGKEQKQFDGKTYLLEEGIVGDFALVKAWKADKLGNLVFRKTSRNFNPLVATAGKVTIAEVEELVEVGELDPNEIHTPAVYVQRIIVGTDYEKRIERRTVR

SEQ ID NO: 361 - protein, 227 aa, Geobacter metallireducens GS-15
KVQSSIEKALEGIQDGATLMVGGFGLVGIPEKLILGLREKGVKNLTVISNNCGVDDFGLGILLQNRQIRKMVSSYVGENKEFERQFLSGELEVELTPQGTLAERIRAGGAGIPAFYTPAGVGTPLAEGREVRSFNGREYLLETGLVADFALVKAWKGDWMGNLIYNKTSRNFNPMMATAAKVTIAEVEDLLDPGELDPAFIHTPGVYVQRIVLCGNYEKRIERRTVR

SEQ ID NO: 362 - protein, 230 aa, Anaeromyxobacter sp. Fw109-5
NKLVESADAAVADIRDGATVMVGGFGLCGNPENLIAALHRKGVKDLTVISNNCGTTEQGLGILLKARQIRKMVSSYVGENKEFERQYLSGELEVELVPQGTLAERIRAGGAGIGGFYTATGVGTQVAEGKETRVIDGREYLLERPLVADFALVYAWKADTWGNLLYRKTTRQFGPMMATAARITIAEVEHVVQPGEIDPDVVHTPSIYVKRLVRGERYEKWIERRTVRPR

SEQ ID NO: 363 - protein, 231 aa, Bacillus sp. B14905
MKDGKVWGSFEEAVADIKDGDMLAVGGFGLCGIPEKAIAALVQKGTKDLTVVSNNCGVDDWGLGLLLANKQIKKMVASYVGENKIFEQQFLSGELEVELTPQGTLAERLRAGGAGIPGFYTATGVGTPIAEGKEVKVFDGKDYILEKGITADFALVKAWKADKLGNLVYRKTSRNFNPLAAMAGKITIAEVEEIVEIGELDPDHIHTPGVFVQRVLLGENYEKRIERLTVK

SEQ ID NO: 364 - protein, 227 aa, Bacillus subtilis subsp. subtilis str. 168
KVLSSSKEAAKLIHDGDTLIAGGFGLCGIPEQLILSIRDQGVKDLTVVSNNCGVDDWGLGLLLANKQIKKMIASYVGENKIFERQFLSGELEVELVPQGTLAERIRAGGAGIPGFYTATGVGTSIAEGKEHKTFGGRTYVLERGITGDVAIVKAWKADTMGNLIFRKTARNFNPIAAMAGKITIAEAEEIVEAGELDPDHIHTPGIYVQHVVLGASQEKRIEKRTVQ

SEQ ID NO: 365 - protein, 251 aa, Artificial
  Substituion in SEQ ID NO 358
MHHGASRLGRMGVRFMRSNKVYESAGAAIADIPNGATLLVGGFGLCGIPMALIQALRDRGVSDLVCVSNNCGVDDWGLGILLQTRQIRKMVSSYVGENKTFERQFLNGELEVELVPQGTLAERIRAGGAGIPAFYTATGVGTSVAEGKEVRTFDGREYVLERAITGDFALIKGWKADKLGNVIYHETERNFNPVMATAAKVTIVEVEELVEPGELDPNFIHTPSIYVHRIVVNPNPLKRIERRTVRPRPQA

SEQ ID NO: 366 - protein, 251 aa, Artificial
  Substituion in SEQ ID NO 358
MHHGASRLGRMGVRFMRSNKVYESAGAAIADIPNGATLLVGGFGLCGIPMALIQALRDRGVSDLVCVSNNCGVDDWGLGILLQTRQIRKMVSSYVGENKTFERQFLNGELEVELVPQGTLAERIRAGGAGIPAFYTATGVGTSVAEGKEVRTFDGREYVLEKAITGDFALIKGWKADKLGNVIYHETERNFNPVMATAAKVTIVEVEELVEPGELDPNFIHTPSIYVHRIVVNPNPIKRIERRTVRPRPQA

SEQ ID NO: 367 - protein, 251 aa, Artificial
  Substituion in SEQ ID NO 358
MHHGASRLGRMGVRFMRSNKVYESAGAAIADIPNGATLLVGGFGLCGIPMALIQALRERGVSDLVCVSNNCGVDDWGLGILLQTRQIRKMVSSYVGENKTFERQFLNGELEVELVPQGTLAERIRAGGAGIPAFYTATGVGTSVAEGKEVRTFDGREYVLERAITGDFALIKGWKADKLGNVIYHETERNFNPVMATAAKVTIVEVEELVEPGELDPNFIHTPSIYVHRIVVNPNPIKRIERRTVRPRPQA

SEQ ID NO: 368 - protein, 251 aa, Artificial
  Substituion in SEQ ID NO 358
MHHGASRLGKMGVRFMRSNKVYESAGAAIADIPNGATLLVGGFGLCGIPMALIQALRDRGVSDLVCVSNNCGVDDWGLGILLQTRQIRKMVSSYVGENKTFERQFLNGELEVELVPQGTLAERIRAGGAGIPAFYTATGVGTSVAEGKEVRTFDGREYVLERAITGDFALIKGWKADKLGNVIYHETERNFNPVMATAAKVTIVEVEELVEPGELDPNFIHTPSIYVHRIVVNPNPIKRIERRTVRPRPQA

SEQ ID NO: 369 - protein, 251 aa, Artificial
  Substituion in SEQ ID NO 358
MHHGASRLGRMGVRFMRSNKVYESAGAAIADIPNGATLLVGGFGLCGIPMALIQALRDRGVSDLVCVSNNCGVDDWGLGILLQTRQIRKMVSSYVGENKTFERQFLNGELEVELVPQGTLAERIRAGGAGIPAFYTATGVGTSVAEGKEVRTFDGREYVLERAITGDFALIKGWKADRLGNVIYHETERNFNPVMATAAKVTIVEVEELVEPGELDPNFIHTPSIYVHRIVVNPNPIKRIERRTVRPRPQA

SEQ ID NO: 370 - DNA, 756 bp, Artificial
  Substituion in SEQ ID NO 359
atgcaccacggcgcgtcgcgtcttggtcgaatgggagtgaggtttatgcgttccaacaaggtgtacgagtcggcgggggccgcaatcgcggacattcccaacggcgccacgctgctcgtcggcggcttcgggctgtgcggcattcccatggcgctcatccaggccctgcgagatcggggcgtgtccgatctggtctgcgtcagcaacaactgcggcgtggacgactggggcctcgggatcttgcttcagacgcggcagatccgcaagatggtctcctcgtacgtcggggagaacaagacgttcgagcgccagtttctgaacggcgaactcgaggtggagttggttccccaagggacgctggccgagcgcatccgcgccggcggcgcgggcatcccggcgttctacaccgccacaggggtcggcacctccgtcgccgagggcaaggaagtgcggacgttcgacggacgcgagtacgtcctcgaacgagccatcactggggattttgcactcatcaagggttggaaggccgacaagctcggcaacgtcatctatcacgagacggagcgcaacttcaatccggtcatggcgacggccgccaaggtcaccatcgtcgaggtggaggagcttgtggagccaggcgaattggatcccaacttcattcatacgccaagcatttacgtgcatcggattgtcgtgaatccgaaccccttaaagcggatcgagcggagaaccgtccgcccgcgtccgcaggcttga

SEQ ID NO: 371 - DNA, 756 bp, Artificial
  Substituion in SEQ ID NO 359
atgcaccacggcgcgtcgcgtcttggtcgaatgggagtgaggtttatgcgttccaacaaggtgtacgagtcggcgggggccgcaatcgcggacattcccaacggcgccacgctgctcgtcggcggcttcgggctgtgcggcattcccatggcgctcatccaggccctgcgagatcggggcgtgtccgatctggtctgcgtcagcaacaactgcggcgtggacgactggggcctcgggatcttgcttcagacgcggcagatccgcaagatggtctcctcgtacgtcggggagaacaagacgttcgagcgccagtttctgaacggcgaactcgaggtggagttggttccccaagggacgctggccgagcgcatccgcgccggcggcgcgggcatcccggcgttctacaccgccacaggggtcggcacctccgtcgccgagggcaaggaagtgcggacgttcgacggacgcgagtacgtcctcgaaaaagccatcactggggattttgcactcatcaagggttggaaggccgacaagctcggcaacgtcatctatcacgagacggagcgcaacttcaatccggtcatggcgacggccgccaaggtcaccatcgtcgaggtggaggagcttgtggagccaggcgaattggatcccaacttcattcatacgccaagcatttacgtgcatcggattgtcgtgaatccgaaccccatcaagcggatcgagcggagaaccgtccgcccgcgtccgcaggcttga

SEQ ID NO: 372 - DNA, 756 bp, Artificial
  Substituion in SEQ ID NO 359
atgcaccacggcgcgtcgcgtcttggtcgaatgggagtgaggtttatgcgttccaacaaggtgtacgagtcggcgggggccgcaatcgcggacattcccaacggcgccacgctgctcgtcggcggcttcgggctgtgcggcattcccatggcgctcatccaggccctgcgagaacggggcgtgtccgatctggtctgcgtcagcaacaactgcggcgtggacgactggggcctcgggatcttgcttcagacgcggcagatccgcaagatggtctcctcgtacgtcggggagaacaagacgttcgagcgccagtttctgaacggcgaactcgaggtggagttggttccccaagggacgctggccgagcgcatccgcgccggcggcgcgggcatcccggcgttctacaccgccacaggggtcggcacctccgtcgccgagggcaaggaagtgcggacgttcgacggacgcgagtacgtcctcgaacgagccatcactggggattttgcactcatcaagggttggaaggccgacaagctcggcaacgtcatctatcacgagacggagcgcaacttcaatccggtcatggcgacggccgccaaggtcaccatcgtcgaggtggaggagcttgtggagccaggcgaattggatcccaacttcattcatacgccaagcatttacgtgcatcggattgtcgtgaatccgaaccccatcaagcggatcgagcggagaaccgtccgcccgcgtccgcaggcttga

SEQ ID NO: 373 - DNA, 756 bp, Artificial
  Substituion in SEQ ID NO 359
atgcaccacggcgcgtcgcgtcttggtaaaatgggagtgaggtttatgcgttccaacaaggtgtacgagtcggcgggggccgcaatcgcggacattcccaacggcgccacgctgctcgtcggcggcttcgggctgtgcggcattcccatggcgctcatccaggccctgcgagatcggggcgtgtccgatctggtctgcgtcagcaacaactgcggcgtggacgactggggcctcgggatcttgcttcagacgcggcagatccgcaagatggtctcctcgtacgtcggggagaacaagacgttcgagcgccagtttctgaacggcgaactcgaggtggagttggttccccaagggacgctggccgagcgcatccgcgccggcggcgcgggcatcccggcgttctacaccgccacaggggtcggcacctccgtcgccgagggcaaggaagtgcggacgttcgacggacgcgagtacgtcctcgaacgagccatcactggggattttgcactcatcaagggttggaaggccgacaagctcggcaacgtcatctatcacgagacggagcgcaacttcaatccggtcatggcgacggccgccaaggtcaccatcgtcgaggtggaggagcttgtggagccaggcgaattggatcccaacttcattcatacgccaagcatttacgtgcatcggattgtcgtgaatccgaaccccatcaagcggatcgagcggagaaccgtccgcccgcgtccgcaggcttga

SEQ ID NO: 374 - DNA, 756 bp, Artificial
  Substituion in SEQ ID NO 359
atgcaccacggcgcgtcgcgtcttggtcgaatgggagtgaggtttatgcgttccaacaaggtgtacgagtcggcgggggccgcaatcgcggacattcccaacggcgccacgctgctcgtcggcggcttcgggctgtgcggcattcccatggcgctcatccaggccctgcgagatcggggcgtgtccgatctggtctgcgtcagcaacaactgcggcgtggacgactggggcctcgggatcttgcttcagacgcggcagatccgcaagatggtctcctcgtacgtcggggagaacaagacgttcgagcgccagtttctgaacggcgaactcgaggtggagttggttccccaagggacgctggccgagcgcatccgcgccggcggcgcgggcatcccggcgttctacaccgccacaggggtcggcacctccgtcgccgagggcaaggaagtgcggacgttcgacggacgcgagtacgtcctcgaacgagccatcactggggattttgcactcatcaagggttggaaggccgaccgtctcggcaacgtcatctatcacgagacggagcgcaacttcaatccggtcatggcgacggccgccaaggtcaccatcgtcgaggtggaggagcttgtggagccaggcgaattggatcccaacttcattcatacgccaagcatttacgtgcatcggattgtcgtgaatccgaaccccatcaagcggatcgagcggagaaccgtccgcccgcgtccgcaggcttga

SEQ ID NO: 375 - protein, 503 aa, Alicyclobacillus acidocaldarius
MFQSAWLMRMAEPWPETQGEWNVTLTRAGNVRVLFRVRLEAGAALGEVHGAIVRAGGEIVAMETRALHADHSVRDITVAVDTEPDVRAVEQALDEVQGVKRLETLDRTFLVHVGGKIATHLKVPVVDRDDLAVVYTPGVARVCEAIRDRRDRAFEFTIRKNTVAVVSDGSAVLGLGNIGPEAAMPVMEGKAMLFKRFADVDAFPICLATQDVDEIVETVERMAPSFGGINLEDISSPRCFEIEERLRKRLDIPVFHDDQHGTAVVMLAGLINALKIVNKRMQDVSVVVAGVGAAGVACTKILLAAGVGHIVGVDRVGIIERGRHYDNPVKQWYAENTNSENRRGTLEEAVRGADVFIGVSGPGILTVGHVKQMARDPIVFAMANPIPEILPEVAAGHVRVMATGRSDYPNQINNVLCFPGMFRGALDVRARDITEEMKQAAALAIAECVPEEQLSEQYIIPSPFDPNVVPAVSRAVQAAAVRSGVARAAAPLELEEEPLYTEM

SEQ ID NO: 376 - DNA, 1512 bp, Alicyclobacillus acidocaldarius
gtgtttcaatccgcctggctgatgcggatggcggagccgtggcccgaaactcagggggagtggaacgtgacactgacgcgtgccggcaatgttcgagttctgtttcgcgttcgcttggaggcgggcgcggcgcttggggaggtgcatggcgccattgtgcgcgccggaggcgagatcgtcgccatggagacccgcgcgctgcatgcggatcacagcgtgcgcgacatcaccgtcgcggtcgataccgagcccgatgtccgggctgtcgagcaagcgctggacgaggtacagggcgtgaaacgcctggagacgctggaccgcacatttctggtccacgtggggggcaaaatcgccacacacctgaaggtgcccgtggtcgatcgcgacgacctggccgttgtgtacacgccgggcgtggcgcgcgtgtgcgaggccattcgggatcgccgcgatcgcgccttcgaattcaccatccgcaagaacacggtggcggtggtgagcgacggctcggccgtgctagggctggggaacattggcccggaggccgccatgccggtcatggaagggaaggcgatgctgttcaagcgcttcgccgacgtggatgccttccccatctgcttggccacgcaggacgtggacgagattgtcgaaaccgtcgagcgaatggcgccgtcgttcggcgggatcaacctcgaggacatctcgtcgccgcggtgtttcgagatcgaggagcggctgcggaaacggctcgacattccggtgtttcacgacgatcagcacggcacagcggtcgtcatgctggccgggctcatcaatgcactgaagattgtgaacaagcggatgcaggatgtgtccgtcgtcgtggcgggggtcggcgcggcaggcgtggcgtgcaccaagatcctgctcgcggccggtgtggggcatatcgtcggcgtggatcgcgtaggcatcatcgagcgcggccgccactatgacaaccccgtgaagcagtggtacgcggagaacacgaactccgagaatcggcgcgggaccctcgaagaagcggtgcgcggcgccgacgtgttcatcggcgtctccggcccgggcatcctgaccgtcggtcacgtcaagcaaatggcgcgcgatcccattgtgtttgccatggcgaatcccatcccggaaatcctgcccgaggtggcggcgggccacgtgcgcgtgatggcgaccggacgatccgactacccgaatcagattaacaacgtgctctgttttcccggcatgttccgcggggcgctcgacgtccgcgcgcgggatatcacggaagagatgaaacaggccgcggcgctcgccatcgccgagtgcgtgccggaagagcaactgtcggagcagtacatcatcccgagcccgttcgatccgaacgtcgtcccggccgtgagccgcgcggtgcaagcagccgcggttcggtccggcgtggcgcgggcggcagctcccctcgagctcgaggaagagcccctctacaccgagatgtag

SEQ ID NO: 377 - protein, 436 aa, Geobacillus kaustophilus HTA426
MNITIRLQFEKDIVSFSDIAAAIGKAGGDIVGIDVISSSKVHTVRDITVSALDTKQCDLIIEALKKIQGVKIINVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKEFAGVDAFPICLNTKDTEEIIQIVKAIAPAFGGINLEDISAPRCFEIEKRLKEELDIPVFHDDQHGTAVVLLAGLLNALKIVDKKLEDIKVVLTGIGAAGIACTKILLAAGVRNIIGVDRHGAIHRDETYENPYWQEYAQITNPDNLKGSLSDVIAGADVFIGVSAPGILKVEDVKKMARDPIVFAMANPIPEIDPELAEPYVRVMATGRSDYPNQINNVLCFPGIFRGALDCRAREINEEMKLAAAKAIASVVTEDELNETYIIPSVFN

SEQ ID NO: 378 - protein, 436 aa, NAD-dependent malic enzyme (NAD-ME) gb|AAA22585.1| malic enzyme (EC 1.1.1.38) Score: 525 Significance: 1e-147 Identities: 268/436 Positives: 336/436 Gaps: 1/436
MNITIRLQFEKDIVSFSDIAAAIGKAGGDIVGIDVISSSKVHTVRDITVSALDTKQCDLIIEALKKIRGVKIVNVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKEFAGVDAFPICLDTKDTEEIIQIVKAIAPAFGGINLEDISAPRCFEIEKRLKEELDIPVFHDDQHGTAVVLLAGLLNALKIVDKKLEDIKVVLTGIGAAGIACTKILLAAGVRNIIGVDRHGAIHRDETYENPYWQEYAQLTNPDNLKGSLSDVIAGADVFIGVSAPGILKVEDVKKMARDPIVFAMANPIPEIDPELAEPYVRVMATGRSDYPNQINNVLCFPGIFRGALDCRAREINEEMKLAAAKAIASVVTEDELNETYIIPSVFN

SEQ ID NO: 379 - protein, 422 aa, Rubrobacter xylanophilus DSM 9941
ALGRILTTIGDAGGMVGAIDIVRMGQERSIRDITVNARDSEHGQRIVRAVGALPEVRVVNVSDRTFLLHLGGKIEVHSKIPVRTRDDLSMAYTPGVARVCRAIAQEPERAFNLTIKRNSVAVVTDGTAVLGLGDIGPYAAMPVMEGKAMLFKEFAGVDAFPVCLDTKDPEEIVRTVKYVAPAFGGINLEDISAPRCFEIEERLKQELDIPVFHDDQHGTAVVVLAALINALRIVGKRMEELKVVVCGVGAAGVACAKILLAAGVKNIVGCDRYGVVYRGRGDADTSRGWFAENTNPENIRGTLADAIRGADVFIGVSAPDVLTVEHIESMADEPIVFAMANPDPEIRPEIAYGHARIIATGRSDYPNQINNVLCFPGVFRGALDIRAREINEEMKLAAARAIAGVIPEESLSEDYIIPSVFD

SEQ ID NO: 380 - protein, 440 aa, Symbiobacterium thermophilum IAM 14863
RLASMRIIVRLEIENTGSIFSYIATAIGASGGDIVAVDLIQSRRDVVVRDITIAVENRAHGDRIVQALAALPGVKVVNVSDRIFLAHLGGKIEVKPRVQVKTRDDLSVVYTPGVADVCRAIAEDPAKAFTLTIKRNTVAVVTDGTAVLGLGNIGPAAALPVMEGKAMLFKQFAGVDAFPICLDTTDPDEIVRIVKAIAPAFGGINLEDISSPRCFEIEERLKEELDIPVFHDDQHGTAVVVLAGLMNAARVVGKELADLRVVVCGIGAAGVAISKMLMAAGITNIVGVDRVGIIERGKTYENPMWQWYAEHTNPENRHGTLDDAIEGADAFIGVSAPNVLKVEHVKKMAKDPIVFAMANPVPEIDPDEAAPYVAVMATGRSDYPNQVNNLLCFPGIFRGALNCRARQINEAMKLAAARAIASVVSDEELHAEYIIPSVFN

SEQ ID NO: 381 - protein, 393 aa, Geobacillus thermodenitrificans NG80-2
MRDITVSALDTKQCDLIIEALKKIRGVKIVNVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKQFAGVDAFPVCLDTKDTEEIIQIVKAIAPAFGGINLEDISAPRCFEIEARLKEELDIPVFHDDQHGTAVVLLAGLLNALKIVDKKLEDIKVVLTGIGAAGIACTKILLAAGVRNIIGVDRYGAIHRDETYENPYWQEYAQITNPYNLKGSLSDVIVGADVFIGVSAPGILKVEDVKKMARDPIVFAMANPVPEIDPELAEPYVRVMATGRSDYPNQINNVLCFPGIFRGALDCRAKEINEEMKLAAAKAIASVVTEDELNETYIIPSVFN

SEQ ID NO: 382 - protein, 503 aa, Artificial
  Substituion in SEQ ID NO 375
MFQSAWLMRMAEPWPETQGEWNVTLTRAGNVRVLFRVRLEAGAALGEVHGAIVRAGGEIVAMETRALHADHSVRDITVAVDTEPDVRAVEQALDEVQGVKRLETLDRTFLVHVGGKIATHLKVPVVDRDDLAVVYTPGVARVCEAIRDRRDRAFEFTIRKNTVAVVSDGSAVLGLGNIGPEAAMPVMEGKAMLFKRFADVDAFPICLATQDVDEIVETVERMAPSFGGINLEDISSPRCFEIEERLRKRLDIPVFHDDQHGTAVVMLAGLINALKIVNKRMQDVSVVVAGVGAAGVACTKILLAAGVGHIVGVDRVGIIERGRHYDNPVKQWYAENTNSENRRGTLEEAVRGADVFIGVSGPGILTVGHVKQMARDPIVFAMANPIPEILPEVAAGHVRVMATGRSDYPNQINNVLCFPGMFRGALDVRARDITEEMKQAAALAIAECVPEEQLSEQYIIPSPFDPNVIPAVSRAVQAAAVRSGVARAAAPLELEEEPLYTEM

SEQ ID NO: 383 - protein, 503 aa, Artificial
  Substituion in SEQ ID NO 375
MFQSAWLMRMAEPWPETQGEWNVTLTRAGNIRVLFRVRLEAGAALGEVHGAIVRAGGEIVAMETRALHADHSVRDITVAVDTEPDVRAVEQALDEVQGVKRLETLDRTFLVHVGGKIATHLKVPVVDRDDLAVVYTPGVARVCEAIRDRRDRAFEFTIRKNTVAVVSDGSAVLGLGNIGPEAAMPVMEGKAMLFKRFADVDAFPICLATQDVDEIVETVERMAPSFGGINLEDISSPRCFEIEERLRKRLDIPVFHDDQHGTAVVMLAGLINALKIVNKRMQDVSVVVAGVGAAGVACTKILLAAGVGHIVGVDRVGIIERGRHYDNPVKQWYAENTNSENRRGTLEEAVRGADVFIGVSGPGILTVGHVKQMARDPIVFAMANPIPEILPEVAAGHVRVMATGRSDYPNQINNVLCFPGMFRGALDVRARDITEEMKQAAALAIAECVPEEQLSEQYIIPSPFDPNVVPAVSRAVQAAAVRSGVARAAAPLELEEEPLYTEM

SEQ ID NO: 384 - protein, 503 aa, Artificial
  Substituion in SEQ ID NO 375
MFQSAWLMRMAEPWPETQGEWNVTLTRAGNVRVLFKVRLEAGAALGEVHGAIVRAGGEIVAMETRALHADHSVRDITVAVDTEPDVRAVEQALDEVQGVKRLETLDRTFLVHVGGKIATHLKVPVVDRDDLAVVYTPGVARVCEAIRDRRDRAFEFTIRKNTVAVVSDGSAVLGLGNIGPEAAMPVMEGKAMLFKRFADVDAFPICLATQDVDEIVETVERMAPSFGGINLEDISSPRCFEIEERLRKRLDIPVFHDDQHGTAVVMLAGLINALKIVNKRMQDVSVVVAGVGAAGVACTKILLAAGVGHIVGVDRVGIIERGRHYDNPVKQWYAENTNSENRRGTLEEAVRGADVFIGVSGPGILTVGHVKQMARDPIVFAMANPIPEILPEVAAGHVRVMATGRSDYPNQINNVLCFPGMFRGALDVRARDITEEMKQAAALAIAECVPEEQLSEQYIIPSPFDPNVVPAVSRAVQAAAVRSGVARAAAPLELEEEPLYTEM

SEQ ID NO: 385 - protein, 503 aa, Artificial
  Substituion in SEQ ID NO 375
MFQSAWLMRMAEPWPETQGEWNVTLTKAGNVRVLFRVRLEAGAALGEVHGAIVRAGGEIVAMETRALHADHSVRDITVAVDTEPDVRAVEQALDEVQGVKRLETLDRTFLVHVGGKIATHLKVPVVDRDDLAVVYTPGVARVCEAIRDRRDRAFEFTIRKNTVAVVSDGSAVLGLGNIGPEAAMPVMEGKAMLFKRFADVDAFPICLATQDVDEIVETVERMAPSFGGINLEDISSPRCFEIEERLRKRLDIPVFHDDQHGTAVVMLAGLINALKIVNKRMQDVSVVVAGVGAAGVACTKILLAAGVGHIVGVDRVGIIERGRHYDNPVKQWYAENTNSENRRGTLEEAVRGADVFIGVSGPGILTVGHVKQMARDPIVFAMANPIPEILPEVAAGHVRVMATGRSDYPNQINNVLCFPGMFRGALDVRARDITEEMKQAAALAIAECVPEEQLSEQYIIPSPFDPNVVPAVSRAVQAAAVRSGVARAAAPLELEEEPLYTEM

SEQ ID NO: 386 - protein, 503 aa, Artificial
  Substituion in SEQ ID NO 375
MFQSAWLMRMAEPWPETQGEWNVTLTRAGNVRVLFRVRLEAGAALGEVHGAIVRAGGEIVAMETRALHADHSVRDITVAVDTEPDVRAVDQALDEVQGVKRLETLDRTFLVHVGGKIATHLKVPVVDRDDLAVVYTPGVARVCEAIRDRRDRAFEFTIRKNTVAVVSDGSAVLGLGNIGPEAAMPVMEGKAMLFKRFADVDAFPICLATQDVDEIVETVERMAPSFGGINLEDISSPRCFEIEERLRKRLDIPVFHDDQHGTAVVMLAGLINALKIVNKRMQDVSVVVAGVGAAGVACTKILLAAGVGHIVGVDRVGIIERGRHYDNPVKQWYAENTNSENRRGTLEEAVRGADVFIGVSGPGILTVGHVKQMARDPIVFAMANPIPEILPEVAAGHVRVMATGRSDYPNQINNVLCFPGMFRGALDVRARDITEEMKQAAALAIAECVPEEQLSEQYIIPSPFDPNVVPAVSRAVQAAAVRSGVARAAAPLELEEEPLYTEM

SEQ ID NO: 387 - DNA, 1512 bp, Artificial
  Substituion in SEQ ID NO 376
gtgtttcaatccgcctggctgatgcggatggcggagccgtggcccgaaactcagggggagtggaacgtgacactgacgcgtgccggcaatgttcgagttctgtttcgcgttcgcttggaggcgggcgcggcgcttggggaggtgcatggcgccattgtgcgcgccggaggcgagatcgtcgccatggagacccgcgcgctgcatgcggatcacagcgtgcgcgacatcaccgtcgcggtcgataccgagcccgatgtccgggctgtcgagcaagcgctggacgaggtacagggcgtgaaacgcctggagacgctggaccgcacatttctggtccacgtggggggcaaaatcgccacacacctgaaggtgcccgtggtcgatcgcgacgacctggccgttgtgtacacgccgggcgtggcgcgcgtgtgcgaggccattcgggatcgccgcgatcgcgccttcgaattcaccatccgcaagaacacggtggcggtggtgagcgacggctcggccgtgctagggctggggaacattggcccggaggccgccatgccggtcatggaagggaaggcgatgctgttcaagcgcttcgccgacgtggatgccttccccatctgcttggccacgcaggacgtggacgagattgtcgaaaccgtcgagcgaatggcgccgtcgttcggcgggatcaacctcgaggacatctcgtcgccgcggtgtttcgagatcgaggagcggctgcggaaacggctcgacattccggtgtttcacgacgatcagcacggcacagcggtcgtcatgctggccgggctcatcaatgcactgaagattgtgaacaagcggatgcaggatgtgtccgtcgtcgtggcgggggtcggcgcggcaggcgtggcgtgcaccaagatcctgctcgcggccggtgtggggcatatcgtcggcgtggatcgcgtaggcatcatcgagcgcggccgccactatgacaaccccgtgaagcagtggtacgcggagaacacgaactccgagaatcggcgcgggaccctcgaagaagcggtgcgcggcgccgacgtgttcatcggcgtctccggcccgggcatcctgaccgtcggtcacgtcaagcaaatggcgcgcgatcccattgtgtttgccatggcgaatcccatcccggaaatcctgcccgaggtggcggcgggccacgtgcgcgtgatggcgaccggacgatccgactacccgaatcagattaacaacgtgctctgttttcccggcatgttccgcggggcgctcgacgtccgcgcgcgggatatcacggaagagatgaaacaggccgcggcgctcgccatcgccgagtgcgtgccggaagagcaactgtcggagcagtacatcatcccgagcccgttcgatccgaacgtcattccggccgtgagccgcgcggtgcaagcagccgcggttcggtccggcgtggcgcgggcggcagctcccctcgagctcgaggaagagcccctctacaccgagatgtag

SEQ ID NO: 388 - DNA, 1512 bp, Artificial
  Substituion in SEQ ID NO 376
gtgtttcaatccgcctggctgatgcggatggcggagccgtggcccgaaactcagggggagtggaacgtgacactgacgcgtgccggcaatattcgagttctgtttcgcgttcgcttggaggcgggcgcggcgcttggggaggtgcatggcgccattgtgcgcgccggaggcgagatcgtcgccatggagacccgcgcgctgcatgcggatcacagcgtgcgcgacatcaccgtcgcggtcgataccgagcccgatgtccgggctgtcgagcaagcgctggacgaggtacagggcgtgaaacgcctggagacgctggaccgcacatttctggtccacgtggggggcaaaatcgccacacacctgaaggtgcccgtggtcgatcgcgacgacctggccgttgtgtacacgccgggcgtggcgcgcgtgtgcgaggccattcgggatcgccgcgatcgcgccttcgaattcaccatccgcaagaacacggtggcggtggtgagcgacggctcggccgtgctagggctggggaacattggcccggaggccgccatgccggtcatggaagggaaggcgatgctgttcaagcgcttcgccgacgtggatgccttccccatctgcttggccacgcaggacgtggacgagattgtcgaaaccgtcgagcgaatggcgccgtcgttcggcgggatcaacctcgaggacatctcgtcgccgcggtgtttcgagatcgaggagcggctgcggaaacggctcgacattccggtgtttcacgacgatcagcacggcacagcggtcgtcatgctggccgggctcatcaatgcactgaagattgtgaacaagcggatgcaggatgtgtccgtcgtcgtggcgggggtcggcgcggcaggcgtggcgtgcaccaagatcctgctcgcggccggtgtggggcatatcgtcggcgtggatcgcgtaggcatcatcgagcgcggccgccactatgacaaccccgtgaagcagtggtacgcggagaacacgaactccgagaatcggcgcgggaccctcgaagaagcggtgcgcggcgccgacgtgttcatcggcgtctccggcccgggcatcctgaccgtcggtcacgtcaagcaaatggcgcgcgatcccattgtgtttgccatggcgaatcccatcccggaaatcctgcccgaggtggcggcgggccacgtgcgcgtgatggcgaccggacgatccgactacccgaatcagattaacaacgtgctctgttttcccggcatgttccgcggggcgctcgacgtccgcgcgcgggatatcacggaagagatgaaacaggccgcggcgctcgccatcgccgagtgcgtgccggaagagcaactgtcggagcagtacatcatcccgagcccgttcgatccgaacgtcgtcccggccgtgagccgcgcggtgcaagcagccgcggttcggtccggcgtggcgcgggcggcagctcccctcgagctcgaggaagagcccctctacaccgagatgtag

SEQ ID NO: 389 - DNA, 1512 bp, Artificial
  Substituion in SEQ ID NO 376
gtgtttcaatccgcctggctgatgcggatggcggagccgtggcccgaaactcagggggagtggaacgtgacactgacgcgtgccggcaatgttcgagttctgtttaaagttcgcttggaggcgggcgcggcgcttggggaggtgcatggcgccattgtgcgcgccggaggcgagatcgtcgccatggagacccgcgcgctgcatgcggatcacagcgtgcgcgacatcaccgtcgcggtcgataccgagcccgatgtccgggctgtcgagcaagcgctggacgaggtacagggcgtgaaacgcctggagacgctggaccgcacatttctggtccacgtggggggcaaaatcgccacacacctgaaggtgcccgtggtcgatcgcgacgacctggccgttgtgtacacgccgggcgtggcgcgcgtgtgcgaggccattcgggatcgccgcgatcgcgccttcgaattcaccatccgcaagaacacggtggcggtggtgagcgacggctcggccgtgctagggctggggaacattggcccggaggccgccatgccggtcatggaagggaaggcgatgctgttcaagcgcttcgccgacgtggatgccttccccatctgcttggccacgcaggacgtggacgagattgtcgaaaccgtcgagcgaatggcgccgtcgttcggcgggatcaacctcgaggacatctcgtcgccgcggtgtttcgagatcgaggagcggctgcggaaacggctcgacattccggtgtttcacgacgatcagcacggcacagcggtcgtcatgctggccgggctcatcaatgcactgaagattgtgaacaagcggatgcaggatgtgtccgtcgtcgtggcgggggtcggcgcggcaggcgtggcgtgcaccaagatcctgctcgcggccggtgtggggcatatcgtcggcgtggatcgcgtaggcatcatcgagcgcggccgccactatgacaaccccgtgaagcagtggtacgcggagaacacgaactccgagaatcggcgcgggaccctcgaagaagcggtgcgcggcgccgacgtgttcatcggcgtctccggcccgggcatcctgaccgtcggtcacgtcaagcaaatggcgcgcgatcccattgtgtttgccatggcgaatcccatcccggaaatcctgcccgaggtggcggcgggccacgtgcgcgtgatggcgaccggacgatccgactacccgaatcagattaacaacgtgctctgttttcccggcatgttccgcggggcgctcgacgtccgcgcgcgggatatcacggaagagatgaaacaggccgcggcgctcgccatcgccgagtgcgtgccggaagagcaactgtcggagcagtacatcatcccgagcccgttcgatccgaacgtcgtcccggccgtgagccgcgcggtgcaagcagccgcggttcggtccggcgtggcgcgggcggcagctcccctcgagctcgaggaagagcccctctacaccgagatgtag

SEQ ID NO: 390 - DNA, 1512 bp, Artificial
  Substituion in SEQ ID NO 376
gtgtttcaatccgcctggctgatgcggatggcggagccgtggcccgaaactcagggggagtggaacgtgacactgacgaaagccggcaatgttcgagttctgtttcgcgttcgcttggaggcgggcgcggcgcttggggaggtgcatggcgccattgtgcgcgccggaggcgagatcgtcgccatggagacccgcgcgctgcatgcggatcacagcgtgcgcgacatcaccgtcgcggtcgataccgagcccgatgtccgggctgtcgagcaagcgctggacgaggtacagggcgtgaaacgcctggagacgctggaccgcacatttctggtccacgtggggggcaaaatcgccacacacctgaaggtgcccgtggtcgatcgcgacgacctggccgttgtgtacacgccgggcgtggcgcgcgtgtgcgaggccattcgggatcgccgcgatcgcgccttcgaattcaccatccgcaagaacacggtggcggtggtgagcgacggctcggccgtgctagggctggggaacattggcccggaggccgccatgccggtcatggaagggaaggcgatgctgttcaagcgcttcgccgacgtggatgccttccccatctgcttggccacgcaggacgtggacgagattgtcgaaaccgtcgagcgaatggcgccgtcgttcggcgggatcaacctcgaggacatctcgtcgccgcggtgtttcgagatcgaggagcggctgcggaaacggctcgacattccggtgtttcacgacgatcagcacggcacagcggtcgtcatgctggccgggctcatcaatgcactgaagattgtgaacaagcggatgcaggatgtgtccgtcgtcgtggcgggggtcggcgcggcaggcgtggcgtgcaccaagatcctgctcgcggccggtgtggggcatatcgtcggcgtggatcgcgtaggcatcatcgagcgcggccgccactatgacaaccccgtgaagcagtggtacgcggagaacacgaactccgagaatcggcgcgggaccctcgaagaagcggtgcgcggcgccgacgtgttcatcggcgtctccggcccgggcatcctgaccgtcggtcacgtcaagcaaatggcgcgcgatcccattgtgtttgccatggcgaatcccatcccggaaatcctgcccgaggtggcggcgggccacgtgcgcgtgatggcgaccggacgatccgactacccgaatcagattaacaacgtgctctgttttcccggcatgttccgcggggcgctcgacgtccgcgcgcgggatatcacggaagagatgaaacaggccgcggcgctcgccatcgccgagtgcgtgccggaagagcaactgtcggagcagtacatcatcccgagcccgttcgatccgaacgtcgtcccggccgtgagccgcgcggtgcaagcagccgcggttcggtccggcgtggcgcgggcggcagctcccctcgagctcgaggaagagcccctctacaccgagatgtag

SEQ ID NO: 391 - DNA, 1512 bp, Artificial
  Substituion in SEQ ID NO 376
gtgtttcaatccgcctggctgatgcggatggcggagccgtggcccgaaactcagggggagtggaacgtgacactgacgcgtgccggcaatgttcgagttctgtttcgcgttcgcttggaggcgggcgcggcgcttggggaggtgcatggcgccattgtgcgcgccggaggcgagatcgtcgccatggagacccgcgcgctgcatgcggatcacagcgtgcgcgacatcaccgtcgcggtcgataccgagcccgatgtccgggctgtcgatcaagcgctggacgaggtacagggcgtgaaacgcctggagacgctggaccgcacatttctggtccacgtggggggcaaaatcgccacacacctgaaggtgcccgtggtcgatcgcgacgacctggccgttgtgtacacgccgggcgtggcgcgcgtgtgcgaggccattcgggatcgccgcgatcgcgccttcgaattcaccatccgcaagaacacggtggcggtggtgagcgacggctcggccgtgctagggctggggaacattggcccggaggccgccatgccggtcatggaagggaaggcgatgctgttcaagcgcttcgccgacgtggatgccttccccatctgcttggccacgcaggacgtggacgagattgtcgaaaccgtcgagcgaatggcgccgtcgttcggcgggatcaacctcgaggacatctcgtcgccgcggtgtttcgagatcgaggagcggctgcggaaacggctcgacattccggtgtttcacgacgatcagcacggcacagcggtcgtcatgctggccgggctcatcaatgcactgaagattgtgaacaagcggatgcaggatgtgtccgtcgtcgtggcgggggtcggcgcggcaggcgtggcgtgcaccaagatcctgctcgcggccggtgtggggcatatcgtcggcgtggatcgcgtaggcatcatcgagcgcggccgccactatgacaaccccgtgaagcagtggtacgcggagaacacgaactccgagaatcggcgcgggaccctcgaagaagcggtgcgcggcgccgacgtgttcatcggcgtctccggcccgggcatcctgaccgtcggtcacgtcaagcaaatggcgcgcgatcccattgtgtttgccatggcgaatcccatcccggaaatcctgcccgaggtggcggcgggccacgtgcgcgtgatggcgaccggacgatccgactacccgaatcagattaacaacgtgctctgttttcccggcatgttccgcggggcgctcgacgtccgcgcgcgggatatcacggaagagatgaaacaggccgcggcgctcgccatcgccgagtgcgtgccggaagagcaactgtcggagcagtacatcatcccgagcccgttcgatccgaacgtcgtcccggccgtgagccgcgcggtgcaagcagccgcggttcggtccggcgtggcgcgggcggcagctcccctcgagctcgaggaagagcccctctacaccgagatgtag

SEQ ID NO: 392 - protein, 395 aa, Alicyclobacillus acidocaldarius
MQDVVIAGAVRTPIGTFQGSLSPLSAPDLGAAVIRESLRRAGVEAGAVDEVVMGNVLQAGVGQNPARQAAMRAGLPEDIPATTVNMVCGSGLKSVMLAAQAIRAGDADVLVAGGMESMSNAPYLLPGAREGYRMGHREVVDSMIRDGLWCAFCDIHMGVTAENVANRHGISREDQDRFALQSQMRAKEAMEAGRFKDEIVPVSVPRRKGEPTLVDCDEHPRPDTTYEALAKLRPAFQADGTVIAGNSSGINDGAAAMLVLARDRAEALGVKPMARIVSYASVGLDPSVMGLGPIEATRRALGRAGLSVEDLDLIEANEAFAAQALAVARELSFPDDKLNVNGGAIALGHPIGASGARILVTLLYELERRGGRFGLATLCIGGGQGVAMVVERMSQ

SEQ ID NO: 393 - DNA, 1188 bp, Alicyclobacillus acidocaldarius
gtgcaagacgtggtgattgcaggggcagtgcggacgcccatcggaacgttccagggaagtctctcgcccctttcggcgccggatctcggtgcggccgtgatccgggagtcgctgcggcgcgcgggagttgaggccggggccgtggacgaagtcgtgatgggcaacgtgctgcaggcgggcgtcggccagaatccagcgcggcaagcggcgatgcgcgcggggctgccggaagacatcccggcgacgacggtgaacatggtgtgcggatcgggcctaaagtcggtcatgctcgcggcgcaggccattcgcgccggggacgcggacgtcttggtggcgggcggcatggagtcgatgtcgaacgcgccgtacctgcttccaggggcgcgcgagggctaccgcatgggccatcgcgaagtggtcgacagcatgatccgggatggcttgtggtgcgcgttttgcgacatccacatgggcgtcactgccgaaaacgtggcgaatcgccacggcatcagccgcgaggatcaggaccgattcgcgctgcagagccagatgcgcgccaaggaagcgatggaggcaggccggttcaaggacgagatcgtgcccgtctccgtgccgcggcggaagggcgagccgaccttggtcgattgcgacgaacatccgcgtcccgacacgacgtacgaggcgctggcgaagcttcggcccgcgtttcaggcggacggcaccgtgatcgccggcaacagctcgggcatcaacgacggcgcggcggccatgctggtgctcgcccgggatcgcgccgaggcgttgggcgtgaagccgatggcgcggatcgtgagctacgcgagcgtgggcttggatccgagcgtgatgggcctcggtcccatcgaggcgacgcgccgagcgctcggccgggcggggctttccgtggaagacctcgacctcatcgaggcgaatgaggcgttcgccgcccaggcgctcgcggtggctcgggaactgtcgttcccggatgacaagttgaacgtgaacggcggcgccatcgcgctcggccaccccatcggcgcgagcggtgcccggatcttggtcacgctgctttacgagctcgagcgccgcggcggccgtttcggcctcgccacactgtgcatcggcggcggacagggcgtggccatggtcgtggagcgcatgtcgcagtga

SEQ ID NO: 394 - protein, 393 aa, Carboxydothermus hydrogenoformans Z-2901
MEEVVIVSAVRTPIGSFLGSLAQTPAVDLGALVIKESLNRINLAPRFVDEVIMGNVLQAGLGQNPARQAAIKAGIPQEVPAFTVNKVCGSGLKSVGLAYQAIATGDADIVVAGGMENMSLAPYVLPKARTGYRMGHDTLIDSMIKDGLWCAFTDVHMGITAENIAEKYNITREEQDKFALQSQERAIKAIDEGKFKEEIVPVIIPQKKGEPLVFSTDEFPKRGTSLEKLAALKPAFKKDGTVTAGNASGINDGAAAVVVMSAKKAQELNIKPLAVIRGYAAAGVDPAYMGLGPIPATRKALKKANLTVSDLGLIEANEAFAAQALAVIKELELNPEITNVNGGAIALGHPIGASGARILVTLLHEMQKRNTKYGLATLCIGGGQGFALVVEKV

SEQ ID NO: 395 - protein, 392 aa, Thermosinus carboxydivorans Nor1
MREVVIASAVRTAIGSFNGTLAPFSAPELGSFVIKAALERANVPASAVDEVIMGNVLQAGLGQNPARQAALKAGLPVEVPTMTINKVCGSGLKAVNLAAQAIMTGDADIVVAGGMESMTNAPYLLDKSRWGYRMGHGKLIDSMITDGLWCAFNDYHMGITAENIVEKYGVTREEQDQLAFESQDKAIKAIASGAFKKEIVPVVIKDKKGDKIFDTDEYPRAGTTVEKLCALKPAFKKDGTVTAGNASGINDGAAALVVMSADKAKELGIKPMARIRSYASAGVDPSIMGMGPVPATRKALAKAGLVMDDIDLIEANEAFAAQFLAVGKELGFVKEKVNVHGGAIALGHPIGASGARILVTLLHAMELRNVKTGLATLCIGGGQGVATIVERM

SEQ ID NO: 396 - protein, 391 aa, Bacillus halodurans C-125
EEVVIASGVRTPIGRFGGHLKDLKAPTLGALVISEALHRAGVLNEQVDEVIMGNVLQAGLGQNPARQAALQAGLPETVPAMTINKVCGSGLKAVHLASQAIACGDAEIVVAGGMENMSQAPYLAVGARNGYRMGHHQLIDSMIHDGLWCAFNDYHMGITAENLCEQYGLSRTELDEFSAWSQEKAVQAIESGRFKDEIVPVDIPQRKGEPIQFDTDEYVKRGTTTETLGALRPAFKKDGKVTAGNASGINDGAAAVVVMSKEKAVELGIKPLVTVRANATAGVEPRIMGIGPVPATKKALTKAGLTMDDIDLIEANEAFAAQSLAVAKELSFAEDRLNVNGGAIALGHPIGASGTRIFVTLLHELLRRGETYGLATLCIGGGQGVATIIER

SEQ ID NO: 397 - protein, 392 aa, Carboxydothermus hydrogenoformans Z-2901
MQEVVILSAVRTAIGKFGGSLKDIPAAELGAIVIKEALVRAQIPPAEVDEVIFGNVLQAGQGQNPARQAAIKAGIPVDIPAMTVNMVCGSGLRSVSLAATLIAAGEADLIVAGGMENMSAAPYAIPGARWGTRMGDGKIVDLMIKDGLWDAFYDYHMGITAENLAERYNISREEQDRFALESQRRAEKAIKEGRFRDEIVPVKLPQRKGEPLEFVQDENPRFDTTLEALAKLKPAFKEGGTVTAGNASSINDGAAALVIASSKKAESLGIKPMAVIRSWGATGVDPSIMGIGPVGATRKALKRAGLTIADIDLVEANEAFAAQALAVAKELELDLSKTNVNGGAIALGHPIGASGARILVTLLHEMKKSNSRYGLATLCIGGGMGVAAIVEK

SEQ ID NO: 398 - protein, 391 aa, Desulfitobacterium hafniense DCB-2
MQDVVIVSAVRTPIASFGGALQGYGAVNLGALVIREAVQRAGIQGKQVDEVIMGNVLQAGLGQNPARQAALKAGLPVETTAQTINVVCGSGLKAVIAAAQAIRAGDAEIVAAGGMESMSDAAFLLDQARWGQRMGHGTLVDSMIKDGLWCAFNEYHMGITAENVAEKYGISRREQDEFAAWSQAKAVAAMEKGRFKEEIVPVAIPQRKGEPVIFDRDEYPRAGTTVETLAKLKPAFKKDGTVTAGNASGINDAAAACVLMSKEKAAALGIPYLAAIKGYGMAGVDPAIMGVGPVNAVKKALQKAGIALDELDLIEANEAFAAQALAVTKELGFPGEKVNVNGGAIALGHPIGASGTRILVTLVHEMKKRRDKLGLATLCIGGGQGIALVVE

SEQ ID NO: 399 - protein, 395 aa, Artificial
  Substituion in SEQ ID NO 392
MQDVVIAGAVRTPIGTFQGSLSPLSAPDLGAAVIRESLRRAGVEAGAVDEVVMGNVLQAGVGQNPARQAAMRAGLPEDIPATTVNMVCGSGLKSVMLAAQAIKAGDADVLVAGGMESMSNAPYLLPGAREGYRMGHREVVDSMIRDGLWCAFCDIHMGVTAENVANRHGISREDQDRFALQSQMRAKEAMEAGRFKDEIVPVSVPRRKGEPTLVDCDEHPRPDTTYEALAKLRPAFQADGTVIAGNSSGINDGAAAMLVLARDRAEALGVKPMARIVSYASVGLDPSVMGLGPIEATRRALGRAGLSVEDLDLIEANEAFAAQALAVARELSFPDDKLNVNGGAIALGHPIGASGARILVTLLYELERRGGRFGLATLCIGGGQGVAMVVERMSQ

SEQ ID NO: 400 - protein, 395 aa, Artificial
  Substituion in SEQ ID NO 392
MQDVVIAGAVRTPIGTFQGSLSPLSAPDLGAAVIRESLRRAGVEAGAVDEVVMGNVLQAGVGQNPARQAAMRAGLPEDIPATTVNMVCGSGLKSVMLAAQAIRAGDADVLVAGGMESMSNAPYLLPGAREGYRMGHREVVDSMIRDGLWCAFCDIHMGVTAENVANRHGISREDQDRFALQSQMRAKEAMEAGRFKDEIVPVSVPRRKGEPTLVDCDEHPRPDTTYEALAKLRPAFQADGTVIAGNSSGINDGAAAMLVLARDRAEALGVKPMARIVSYASVGLDPSVMGLGPIEATRRALGRAGLSVEDLDLIEANEAFAAQALAVARELSFPDDKLNVNGGAIALGHPIGASGARILVTLLYELERRGGRFGLATLCIGGGNGVAMVVERMSQ

SEQ ID NO: 401 - protein, 395 aa, Artificial
  Substituion in SEQ ID NO 392
MQDVVIAGAVRTPIGTFQGSLSPLSAPDLGAAVIRESLRRAGVEAGAVDEVVMGNVLQAGVGQNPARQAAMRAGLPEDIPATTVNMVCGSGLKSVMLAAQAIRAGDADVLVAGGMESMSNAPYLLPGAREGYRMGHREVVDSMIRDGLWCAFCDIHMGVTAENVANRHGISREDQDRFALQSQMRAKEAMEAGRFKDEIVPVSVPRRKGEPTLVDCDEHPRPDTTYEALAKLRPAFQADGTVIAGNSSGINDGAAAMLVLARDRADALGVKPMARIVSYASVGLDPSVMGLGPIEATRRALGRAGLSVEDLDLIEANEAFAAQALAVARELSFPDDKLNVNGGAIALGHPIGASGARILVTLLYELERRGGRFGLATLCIGGGQGVAMVVERMSQ

SEQ ID NO: 402 - protein, 395 aa, Artificial
  Substituion in SEQ ID NO 392
MQDVVIAGAVRTPIGTFQGSLSPLSAPDLGAAVIRESLRRAGVEAGAVDEVVMGNVLQAGVGQNPARQAAMRAGLPEDIPATTVNMVCGSGLKSVMLAAQAIRAGDADVLVAGGMESMSNAPYLLPGAREGYRMGHREVVDSMIRDGLWCAFCDIHMGVTAENVANRHGISREDQDRFALQSQMRAKEAMEAGRFKDEIVPVSVPRRKGEPTLVDCDEHPRPDTTYEALAKLRPAFQADGTVIAGNSSGINDGAAAMLVLARDRAEALGVKPMARIVSYASVGLDPSVMGLGPIEATRRALGRAGLSVEDLDLIEANEAFAAQALAVARELSFPEDKLNVNGGAIALGHPIGASGARILVTLLYELERRGGRFGLATLCIGGGQGVAMVVERMSQ

SEQ ID NO: 403 - protein, 395 aa, Artificial
  Substituion in SEQ ID NO 392
MQDVVIAGAVRTPIGTFQGSLSPLSAPDLGAAVIRESLRRAGVEAGAVDEVVMGNVLQAGVGQNPARQAAMRAGLPEDIPATTVNMVCGSGLKSVMLAAQAIRAGDADVLVAGGMESMSNAPYLLPGAREGYRMGHREVVDSMIKDGLWCAFCDIHMGVTAENVANRHGISREDQDRFALQSQMRAKEAMEAGRFKDEIVPVSVPRRKGEPTLVDCDEHPRPDTTYEALAKLRPAFQADGTVIAGNSSGINDGAAAMLVLARDRAEALGVKPMARIVSYASVGLDPSVMGLGPIEATRRALGRAGLSVEDLDLIEANEAFAAQALAVARELSFPDDKLNVNGGAIALGHPIGASGARILVTLLYELERRGGRFGLATLCIGGGQGVAMVVERMSQ

SEQ ID NO: 404 - DNA, 1188 bp, Artificial
  Substituion in SEQ ID NO 393
gtgcaagacgtggtgattgcaggggcagtgcggacgcccatcggaacgttccagggaagtctctcgcccctttcggcgccggatctcggtgcggccgtgatccgggagtcgctgcggcgcgcgggagttgaggccggggccgtggacgaagtcgtgatgggcaacgtgctgcaggcgggcgtcggccagaatccagcgcggcaagcggcgatgcgcgcggggctgccggaagacatcccggcgacgacggtgaacatggtgtgcggatcgggcctaaagtcggtcatgctcgcggcgcaggccattaaagccggggacgcggacgtcttggtggcgggcggcatggagtcgatgtcgaacgcgccgtacctgcttccaggggcgcgcgagggctaccgcatgggccatcgcgaagtggtcgacagcatgatccgggatggcttgtggtgcgcgttttgcgacatccacatgggcgtcactgccgaaaacgtggcgaatcgccacggcatcagccgcgaggatcaggaccgattcgcgctgcagagccagatgcgcgccaaggaagcgatggaggcaggccggttcaaggacgagatcgtgcccgtctccgtgccgcggcggaagggcgagccgaccttggtcgattgcgacgaacatccgcgtcccgacacgacgtacgaggcgctggcgaagcttcggcccgcgtttcaggcggacggcaccgtgatcgccggcaacagctcgggcatcaacgacggcgcggcggccatgctggtgctcgcccgggatcgcgccgaggcgttgggcgtgaagccgatggcgcggatcgtgagctacgcgagcgtgggcttggatccgagcgtgatgggcctcggtcccatcgaggcgacgcgccgagcgctcggccgggcggggctttccgtggaagacctcgacctcatcgaggcgaatgaggcgttcgccgcccaggcgctcgcggtggctcgggaactgtcgttcccggatgacaagttgaacgtgaacggcggcgccatcgcgctcggccaccccatcggcgcgagcggtgcccggatcttggtcacgctgctttacgagctcgagcgccgcggcggccgtttcggcctcgccacactgtgcatcggcggcggacagggcgtggccatggtcgtggagcgcatgtcgcagtga

SEQ ID NO: 405 - DNA, 1188 bp, Artificial
  Substituion in SEQ ID NO 393
gtgcaagacgtggtgattgcaggggcagtgcggacgcccatcggaacgttccagggaagtctctcgcccctttcggcgccggatctcggtgcggccgtgatccgggagtcgctgcggcgcgcgggagttgaggccggggccgtggacgaagtcgtgatgggcaacgtgctgcaggcgggcgtcggccagaatccagcgcggcaagcggcgatgcgcgcggggctgccggaagacatcccggcgacgacggtgaacatggtgtgcggatcgggcctaaagtcggtcatgctcgcggcgcaggccattcgcgccggggacgcggacgtcttggtggcgggcggcatggagtcgatgtcgaacgcgccgtacctgcttccaggggcgcgcgagggctaccgcatgggccatcgcgaagtggtcgacagcatgatccgggatggcttgtggtgcgcgttttgcgacatccacatgggcgtcactgccgaaaacgtggcgaatcgccacggcatcagccgcgaggatcaggaccgattcgcgctgcagagccagatgcgcgccaaggaagcgatggaggcaggccggttcaaggacgagatcgtgcccgtctccgtgccgcggcggaagggcgagccgaccttggtcgattgcgacgaacatccgcgtcccgacacgacgtacgaggcgctggcgaagcttcggcccgcgtttcaggcggacggcaccgtgatcgccggcaacagctcgggcatcaacgacggcgcggcggccatgctggtgctcgcccgggatcgcgccgaggcgttgggcgtgaagccgatggcgcggatcgtgagctacgcgagcgtgggcttggatccgagcgtgatgggcctcggtcccatcgaggcgacgcgccgagcgctcggccgggcggggctttccgtggaagacctcgacctcatcgaggcgaatgaggcgttcgccgcccaggcgctcgcggtggctcgggaactgtcgttcccggatgacaagttgaacgtgaacggcggcgccatcgcgctcggccaccccatcggcgcgagcggtgcccggatcttggtcacgctgctttacgagctcgagcgccgcggcggccgtttcggcctcgccacactgtgcatcggcggcggaaatggcgtggccatggtcgtggagcgcatgtcgcagtga

SEQ ID NO: 406 - DNA, 1188 bp, Artificial
  Substituion in SEQ ID NO 393
gtgcaagacgtggtgattgcaggggcagtgcggacgcccatcggaacgttccagggaagtctctcgcccctttcggcgccggatctcggtgcggccgtgatccgggagtcgctgcggcgcgcgggagttgaggccggggccgtggacgaagtcgtgatgggcaacgtgctgcaggcgggcgtcggccagaatccagcgcggcaagcggcgatgcgcgcggggctgccggaagacatcccggcgacgacggtgaacatggtgtgcggatcgggcctaaagtcggtcatgctcgcggcgcaggccattcgcgccggggacgcggacgtcttggtggcgggcggcatggagtcgatgtcgaacgcgccgtacctgcttccaggggcgcgcgagggctaccgcatgggccatcgcgaagtggtcgacagcatgatccgggatggcttgtggtgcgcgttttgcgacatccacatgggcgtcactgccgaaaacgtggcgaatcgccacggcatcagccgcgaggatcaggaccgattcgcgctgcagagccagatgcgcgccaaggaagcgatggaggcaggccggttcaaggacgagatcgtgcccgtctccgtgccgcggcggaagggcgagccgaccttggtcgattgcgacgaacatccgcgtcccgacacgacgtacgaggcgctggcgaagcttcggcccgcgtttcaggcggacggcaccgtgatcgccggcaacagctcgggcatcaacgacggcgcggcggccatgctggtgctcgcccgggatcgcgccgatgcgttgggcgtgaagccgatggcgcggatcgtgagctacgcgagcgtgggcttggatccgagcgtgatgggcctcggtcccatcgaggcgacgcgccgagcgctcggccgggcggggctttccgtggaagacctcgacctcatcgaggcgaatgaggcgttcgccgcccaggcgctcgcggtggctcgggaactgtcgttcccggatgacaagttgaacgtgaacggcggcgccatcgcgctcggccaccccatcggcgcgagcggtgcccggatcttggtcacgctgctttacgagctcgagcgccgcggcggccgtttcggcctcgccacactgtgcatcggcggcggacagggcgtggccatggtcgtggagcgcatgtcgcagtga

SEQ ID NO: 407 - DNA, 1188 bp, Artificial
  Substituion in SEQ ID NO 393
gtgcaagacgtggtgattgcaggggcagtgcggacgcccatcggaacgttccagggaagtctctcgcccctttcggcgccggatctcggtgcggccgtgatccgggagtcgctgcggcgcgcgggagttgaggccggggccgtggacgaagtcgtgatgggcaacgtgctgcaggcgggcgtcggccagaatccagcgcggcaagcggcgatgcgcgcggggctgccggaagacatcccggcgacgacggtgaacatggtgtgcggatcgggcctaaagtcggtcatgctcgcggcgcaggccattcgcgccggggacgcggacgtcttggtggcgggcggcatggagtcgatgtcgaacgcgccgtacctgcttccaggggcgcgcgagggctaccgcatgggccatcgcgaagtggtcgacagcatgatccgggatggcttgtggtgcgcgttttgcgacatccacatgggcgtcactgccgaaaacgtggcgaatcgccacggcatcagccgcgaggatcaggaccgattcgcgctgcagagccagatgcgcgccaaggaagcgatggaggcaggccggttcaaggacgagatcgtgcccgtctccgtgccgcggcggaagggcgagccgaccttggtcgattgcgacgaacatccgcgtcccgacacgacgtacgaggcgctggcgaagcttcggcccgcgtttcaggcggacggcaccgtgatcgccggcaacagctcgggcatcaacgacggcgcggcggccatgctggtgctcgcccgggatcgcgccgaggcgttgggcgtgaagccgatggcgcggatcgtgagctacgcgagcgtgggcttggatccgagcgtgatgggcctcggtcccatcgaggcgacgcgccgagcgctcggccgggcggggctttccgtggaagacctcgacctcatcgaggcgaatgaggcgttcgccgcccaggcgctcgcggtggctcgggaactgtcgttcccggaagacaagttgaacgtgaacggcggcgccatcgcgctcggccaccccatcggcgcgagcggtgcccggatcttggtcacgctgctttacgagctcgagcgccgcggcggccgtttcggcctcgccacactgtgcatcggcggcggacagggcgtggccatggtcgtggagcgcatgtcgcagtga

SEQ ID NO: 408 - DNA, 1188 bp, Artificial
  Substituion in SEQ ID NO 393
gtgcaagacgtggtgattgcaggggcagtgcggacgcccatcggaacgttccagggaagtctctcgcccctttcggcgccggatctcggtgcggccgtgatccgggagtcgctgcggcgcgcgggagttgaggccggggccgtggacgaagtcgtgatgggcaacgtgctgcaggcgggcgtcggccagaatccagcgcggcaagcggcgatgcgcgcggggctgccggaagacatcccggcgacgacggtgaacatggtgtgcggatcgggcctaaagtcggtcatgctcgcggcgcaggccattcgcgccggggacgcggacgtcttggtggcgggcggcatggagtcgatgtcgaacgcgccgtacctgcttccaggggcgcgcgagggctaccgcatgggccatcgcgaagtggtcgacagcatgatcaaagatggcttgtggtgcgcgttttgcgacatccacatgggcgtcactgccgaaaacgtggcgaatcgccacggcatcagccgcgaggatcaggaccgattcgcgctgcagagccagatgcgcgccaaggaagcgatggaggcaggccggttcaaggacgagatcgtgcccgtctccgtgccgcggcggaagggcgagccgaccttggtcgattgcgacgaacatccgcgtcccgacacgacgtacgaggcgctggcgaagcttcggcccgcgtttcaggcggacggcaccgtgatcgccggcaacagctcgggcatcaacgacggcgcggcggccatgctggtgctcgcccgggatcgcgccgaggcgttgggcgtgaagccgatggcgcggatcgtgagctacgcgagcgtgggcttggatccgagcgtgatgggcctcggtcccatcgaggcgacgcgccgagcgctcggccgggcggggctttccgtggaagacctcgacctcatcgaggcgaatgaggcgttcgccgcccaggcgctcgcggtggctcgggaactgtcgttcccggatgacaagttgaacgtgaacggcggcgccatcgcgctcggccaccccatcggcgcgagcggtgcccggatcttggtcacgctgctttacgagctcgagcgccgcggcggccgtttcggcctcgccacactgtgcatcggcggcggacagggcgtggccatggtcgtggagcgcatgtcgcagtga

SEQ ID NO: 409 - protein, 662 aa, Alicyclobacillus acidocaldarius
MRRDPRGRRSVEHDRERPAHPATGGLRGPVLSLELRRVPREISSVHRRSGGILGRDRRRVGMAAARKDGHRGRASRFSVLSRKLHQRVRKLRGSTSQAPDVRNKVALFFEGEDGERRSVTYLQLQDAVSRFANALKDLGLRQGDVVCVYMQNLIETYVALLACLRIGVLYNTVFAGFSAEALRERIVRCGAKAVICANGSLRRGRVLRLKETVDRALEGVETVEHVIVYRRLPDLDTPMTPGRDLDFESLVERASRDCPPAVLEANEPAFLIFTSGTTGRPKGIVHAGGGFLLGTYAYTKYQLDLRPEDVYWNTADIGWLTSHIFVLVGGLALGTTTILYEGALDWPKSGRLYEMIERYRVNKLFSAPTAYRMMMKHGEDIARQYDLSSLELLVSVGEPFNPEAWHWVRRVVGGDVAVINNTWGQTETGGTPLALLPGAVPMKPGSCGVPFFGHDLAVVDEQGREVPDGVPGYLVIRRPFPSLARDVYGDRNLYLNAYFSRMPGLYFTGDSAVRDADGHFWVLGRVDDVINVSGHRISTMEMESSLIQHPAVVEAAVVGEPDDVKGQVPVAFVTLERGWEPSTDLEEELKARVVADIGSFARPARVYFVEAMPKTRSGKILRRMLREILQTGEVKGDVTGLEDWEVVERLLHDLRERAPGGE

SEQ ID NO: 410 - DNA, 1989 bp, Alicyclobacillus acidocaldarius
ttgaggagggatcctcgtggcagacgaagtgttgagcatgatcgcgagcgcccggctcatcccgccaccggaggcctacgcggcccggtcttatctctcgagctacgacgagtaccgcgcgagatatcaagcgtccatcgacgatccggcggcattctgggacgagatcgccgacgagttggtatggcagcagcgcggaaagacggtcatcgcgggcgagcttcccgattttcagttctttcccggaagttacatcaacgtgtgcgaaaactgcgtggatcgacaagccaagcacccgatgtacgcaacaaggtggcgctcttcttcgagggggaggacggcgaacgccgcagcgtgacgtacctccagctccaggatgccgtgtcccggtttgcgaacgcgctcaaagatctcgggctgcgacagggcgatgtggtctgcgtgtacatgcaaaatctcatcgagacctacgtcgcgctcttggcgtgcctgcgcatcggcgtgctctacaacacggtgtttgcgggattttccgccgaggcgctgcgcgagcggattgtgcggtgcggggccaaggcggtgatctgcgccaacggaagtctcaggcgcggccgggtgcttcggctgaaggaaaccgtcgaccgggcgcttgaaggtgtggagaccgtggagcacgtcatcgtctaccggcgcctgcccgatctcgacacgccgatgacgccggggcgcgatctcgactttgagtcgctcgtcgagcgcgcctcccgggactgccctcctgctgtactggaggcgaacgagcccgccttcctcatcttcacgagcggaacgacgggccggccgaaaggcatcgtccacgccggcggcggatttctgcttggaacctacgcgtacacgaagtaccagctcgacctccggcccgaggacgtgtactggaacacagcggacatcggctggctcacatctcacatcttcgtgctggtcggcggtctcgccttaggcaccacgaccatcctgtacgagggcgcgctggattggcccaaatcgggcaggctatacgagatgatcgagcgataccgcgtcaacaaactgttctcggcacccaccgcctatcggatgatgatgaaacacggcgaggacatcgcgcggcaatacgacttgtcgtcgcttgaactcttggtgtcggtcggagagccgttcaatcccgaggcgtggcattgggtccgccgcgttgtcggcggtgacgtcgctgtcatcaacaacacctggggccagaccgagaccggtggaacgccgctcgcgctgttgccaggggcggtgcccatgaaacccggctcgtgtggcgtgccgttcttcggacacgatctcgccgtcgtggatgaacagggccgggaggtgccggacggggtgcccggatatctcgtgatccgccgtccgttcccgtcgctcgcgcgcgacgtgtacggcgatcggaacctgtacctgaacgcgtacttctcgcgtatgcccgggctctacttcacgggcgacagcgcggtccgggatgcggatggccacttctgggtgctcggccgggtcgacgacgtgatcaacgtgtcgggccaccgaatcagcacgatggagatggagagctcgctcatccagcatccggccgtggtggaggcggcggtcgtgggcgagcctgacgacgtgaagggccaggtccccgttgcgttcgtgacgctcgagcgcgggtgggaaccgagcacggacctggaggaggaactgaaggcgcgcgtcgtggcggacatcggttcgtttgcgcggccggcgcgcgtgtacttcgtggaggcgatgccgaagacgcgatcgggcaagatcctgcggcggatgctgcgcgagatcctgcagacgggcgaagtgaaaggggacgtcaccggcctggaggactgggaggtcgtggaacggcttctgcacgatttgcgcgagcgggcgccgggcggtgaatga

SEQ ID NO: 411 - protein, 552 aa, Rubrobacter xylanophilus DSM 9941
RNKAALLWESEDGRREVWTYQQLADEVNRFANVLRELGVGRGDVVAIYMGNIPEVFVSVHACYRIGALYSIIFAGFSTDAVRQRLEDARPKVVVVADATSRRGREVPLKRTLDQALAGIDSVETVVVVPRAGAETELREGRDRLYGDLVSRAGAWCPPEPMEANEPGFIIYTSGTESRPKGLVHAGLGFLVGTYADVKWSMNPQDDDVYWCTADVGWLTFPIWSLVGGLAHGTTMVVYEGALNHPDPGRFYEILERYRVNKVFTAPTALRMLRGAGERWLEGRDLSALKLVSLVGEPIDPETWHWVREVVGRGEAFVNNTYGQTETATGWTSAIVGLTGAKPGSCGIPLPGYVSEVVDEGGRPVPPGTPGYLTITEPFPCLARTVWGDHQRYLSTYFERFPGRYFSADACVVDRDGHYWVTGRVDDVINVAGHRLGTMEMESALLNHPDVAEAAVIGVPDATKGTVPVAFALLRAGAEPRPGLREELEQRIVERVGSIARPAAVHIVSALPKTRSGKIMRRLLRELVTEGRVRGDTTALEDPESVSVLEKEL

SEQ ID NO: 412 - protein, 559 aa, Deinococcus radiodurans R1
KNRVALYYEREDGLKETWSYGDLTDATARFAAALQDLGVDKGDRVAIYLSNVPEAFIAIHACYRIGAIYSVIFAGFSASAVRDRLTDAQPKVVVCTDGTLRRGRNIPLKATLDEALEGLEKPTVIVARRLDPFLPLGENELDFAELLEKTTRRAAPVSLDANDPGFIIYTSGTTSKPKGLVHSGIGFLTGTYANVKWALNLQPDDVYWCTADVGWLTFPIFALVGGLAHGATHVIYEGSIDTPTPERPYQIIERYRADKVFTAPTALRMLRRSGDEALARYDLSPLQLVALVGEPLDPETWHWTHDVLGGGRLFVNNTYGQTETGTAWASSMVGLTEGRPGSCGHPLPGYRAAVVHEDGTPCGPNELGSLTLTEPFPCLARTVWGDHDRYVETYLSEFPGKYAAADAALLDSDGQLWVTGRLDDVMNVAGHRLGTMEMEAALLTHPAVSEAAVVAMPDDIKGAVPVAFVVPRAGIRLDTDLTWLENELADAVVSGVGAIARPGRVVVTPTVPRTRSGKIMRRLLRDLLLTGEVKGDLTSLENPDALETVRERLGGAAAG

SEQ ID NO: 413 - protein, 553 aa, Carboxydothermus hydrogenoformans Z-2901
RNKAALIFEGEPGDSKILTYQELYREVNKFANVLKKLGVQKGDRVTIYMPMIPEAVIAMLACTRIGAPHSVVFGGFSSQALKDRIDDAKAKLLITADGGYRRGSIVELKKNADAALEGETTIEKVVVVKRTGQEVPMTEGRDYWYHELMADAALYCEPEQCDAEDMLFILYSSGTTGKPKGIQHTTGGYLVGVHTTFKYIFDYREEDIYWCTADIGWITGHSYIVYGPLSNGATVVLYEGAPDWPQKDRFWEIIEKYRVNILYTAPTAIRTFMRWGEKWPKGRDLSSLRLLGTVGEPINPEAWIWYHEHIGGGRCPIVDTWWQTETGMIMITPLPGVIPTKPGSATKPFPGVEADVVNDKGEPVPPGQGGYLVLKKPWPAMLRTLYGDPERYKNTYWSKFPGWYFTGDGAKKDEDGYFWILGRVDDVINVSGHRIGTMEVESALVEHPLVAEAAVIGKSHEVKGQAIAAFVTLKEGVEGTPELVQELKQFVAQKIGALARPDDIFFTAELPKTRSGKIMRRLLRDIAEGRALGDTTTLTDPAVINKIKEQYKD

SEQ ID NO: 414 - protein, 551 aa, Deinococcus geothermalis DSM 11300
RTALLYEREDGLRETWTYGELTDATARFAAALQDLGVAKGDRVAIYLGNVPEAFIAIHACYRIGAIYSVIFAGFSASAVRDRLTDARPKVVICTDATLRRGKVIPLKATLDEALEGLEIGHVIVARRVDRESALRGGEHDFHALLNSTARRADPVPLEANEPGFIIYTSGTTSKPKGLVHAGLGFLAGAYANVKWALNLCPQDVYWCTADVGWLTFPIFALVGGLAHGATHVIYEGSIDTPTPARPYEIIERYGVNKVFTAPTALRMLRRAGDSALAGHDLNTLELIALVGEPLDPETWHWTRERLGAGRIFVNNTYGQTETGTAWASSMVGLTPTRPGSCGHPLPGYRARVVREDGQAAAPGELGALTLTEPFPCLARTVWGDHERYVQTYLADFPGSYAASDAALLDGDGQLWVTGRLDDVMNVAGHRIGTMELEAALITHPAVSEAAVVAQPDEVKGSVPVAFVVPRGDAQVGPGLEEELAEAIVRGVGPIARPARVIVTPTVPRTRSGKIMRRLLRDLLVSGEVRGDLTSLENPDAIEVVRERLAGG

SEQ ID NO: 415 - protein, 551 aa, Acidobacteria bacterium Ellin345
RHKAAFIWEGEPGDVRTLTYQQLWLEVQKFANVLLDLGIKKGDRVAIYMGMVPELPVAMLACARIGATHSVIFGGFSANALVDRITDQQAVAVITQDGSWRRGNEVKLKVAVDEALEKCPTVKHVVVYKRTASAINMKEGRDHWWHDLMAKAKDHCPAEPLDAEHPLYILYTSGTTGKPKGIVHTTGGYAVGTYYTTKMVFDLKEDDTFWCTADIGWVTGHSYIVYGPLQTGATTVMYEGAPNFPDLDRFWALVAKHKVTVFYTAPTAIRTFMKWGAEYPNRHDMSTLRLLGSVGEPINPEAWMWYRDVIGKDRCPIVDTWWQTETGAIMISPLPGAIATKPGSATKPLPGIIAEVVTRAGEKVPLGSGGFLVIKKPWPSMMRTIYGDPERYKHQYWSDIPGVYFTGDGAREDKDGYFWIMGRVDDVLNVSGHRLSTMEIESALVAHPKVAEAAVVGRPDEMKGQAVSAFVTLESGSKPSPELKEELRAWVAKEIGSMAKPDDIRFTDTLPKTRSGKIMRRLLRELATGGDVKGDTTTLEDFTVIAKLKED

SEQ ID NO: 416 - protein, 662 aa, Artificial
  Substituion in SEQ ID NO 409
MRRDPRGRRSVEHDRERPAHPATGGLRGPVLSLELRRVPREISSVHRRSGGILGRDRRRVGMAAARKDGHRGRASRFSVLSRKLHQRVRKLRGSTSQAPDVRNKVALFFEGEDGERRSVTYLQLQDAVSRFANALKDLGLRQGDVVCVYMQNLIETYVALLACLRIGVLYNTVFAGFSAEALRERIVRCGAKAVICANGSLRRGRVLRLKETVDRALEGVETVEHVIVYRRLPDLDTPMTPGRDLDFESLVERASRDCPPAVLEANEPAFLIFTSGTTGRPKGIVHAGGGFLLGTYAYTKYQLDLRPEDVYWNTADIGWLTSHIFVLVGGLALGTTTILYEGALDWPKSGRLYEMIERYRVNKLFSAPTAYRMMMKHGEDIAKQYDLSSLELLVSVGEPFNPEAWHWVRRVVGGDVAVINNTWGQTETGGTPLALLPGAVPMKPGSCGVPFFGHDLAVVDEQGREVPDGVPGYLVIRRPFPSLARDVYGDRNLYLNAYFSRMPGLYFTGDSAVRDADGHFWVLGRVDDVINVSGHRISTMEMESSLIQHPAVVEAAVVGEPDDVKGQVPVAFVTLERGWEPSTDLEEELKARVVADIGSFARPARVYFVEAMPKTRSGKILRRMLREILQTGEVKGDVTGLEDWEVVERLLHDLRERAPGGE

SEQ ID NO: 417 - protein, 662 aa, Artificial
  Substituion in SEQ ID NO 409
MRRDPRGRRSVEHDRERPAHPATGGLRGPVLSLELRRVPREISSVHRRSGGILGRDRRRVGMAAARKDGHRGRASRFSVLSRKLHQRVRKLRGSTSQAPDVRNKVALFFEGEDGERRSVTYLQLQDAVSRFANALKDLGLRQGDVVCVYMQNLIETYVALLACLRIGVLYNTVFAGFSAEALRERIVKCGAKAVICANGSLRRGRVLRLKETVDRALEGVETVEHVIVYRRLPDLDTPMTPGRDLDFESLVERASRDCPPAVLEANEPAFLIFTSGTTGRPKGIVHAGGGFLLGTYAYTKYQLDLRPEDVYWNTADIGWLTSHIFVLVGGLALGTTTILYEGALDWPKSGRLYEMIERYRVNKLFSAPTAYRMMMKHGEDIARQYDLSSLELLVSVGEPFNPEAWHWVRRVVGGDVAVINNTWGQTETGGTPLALLPGAVPMKPGSCGVPFFGHDLAVVDEQGREVPDGVPGYLVIRRPFPSLARDVYGDRNLYLNAYFSRMPGLYFTGDSAVRDADGHFWVLGRVDDVINVSGHRISTMEMESSLIQHPAVVEAAVVGEPDDVKGQVPVAFVTLERGWEPSTDLEEELKARVVADIGSFARPARVYFVEAMPKTRSGKILRRMLREILQTGEVKGDVTGLEDWEVVERLLHDLRERAPGGE

SEQ ID NO: 418 - protein, 662 aa, Artificial
  Substituion in SEQ ID NO 409
MRRDPRGRRSVEHDRERPAHPATGGLRGPVLSLELRRVPRELSSVHRRSGGILGRDRRRVGMAAARKDGHRGRASRFSVLSRKLHQRVRKLRGSTSQAPDVRNKVALFFEGEDGERRSVTYLQLQDAVSRFANALKDLGLRQGDVVCVYMQNLIETYVALLACLRIGVLYNTVFAGFSAEALRERIVRCGAKAVICANGSLRRGRVLRLKETVDRALEGVETVEHVIVYRRLPDLDTPMTPGRDLDFESLVERASRDCPPAVLEANEPAFLIFTSGTTGRPKGIVHAGGGFLLGTYAYTKYQLDLRPEDVYWNTADIGWLTSHIFVLVGGLALGTTTILYEGALDWPKSGRLYEMIERYRVNKLFSAPTAYRMMMKHGEDIARQYDLSSLELLVSVGEPFNPEAWHWVRRVVGGDVAVINNTWGQTETGGTPLALLPGAVPMKPGSCGVPFFGHDLAVVDEQGREVPDGVPGYLVIRRPFPSLARDVYGDRNLYLNAYFSRMPGLYFTGDSAVRDADGHFWVLGRVDDVINVSGHRISTMEMESSLIQHPAVVEAAVVGEPDDVKGQVPVAFVTLERGWEPSTDLEEELKARVVADIGSFARPARVYFVEAMPKTRSGKILRRMLREILQTGEVKGDVTGLEDWEVVERLLHDLRERAPGGE

SEQ ID NO: 419 - protein, 662 aa, Artificial
  Substituion in SEQ ID NO 409
MRRDPRGRRSVEHDRERPAHPATGGLRGPVLSLELRRVPREISSVHRRSGGILGRDRRRVGMAAARKDGHRGRASRFSVLSRKLHQRVRKLRGSTSQAPDVRNKVALFFEGEDGERRSVTYLQLNDAVSRFANALKDLGLRQGDVVCVYMQNLIETYVALLACLRIGVLYNTVFAGFSAEALRERIVRCGAKAVICANGSLRRGRVLRLKETVDRALEGVETVEHVIVYRRLPDLDTPMTPGRDLDFESLVERASRDCPPAVLEANEPAFLIFTSGTTGRPKGIVHAGGGFLLGTYAYTKYQLDLRPEDVYWNTADIGWLTSHIFVLVGGLALGTTTILYEGALDWPKSGRLYEMIERYRVNKLFSAPTAYRMMMKHGEDIARQYDLSSLELLVSVGEPFNPEAWHWVRRVVGGDVAVINNTWGQTETGGTPLALLPGAVPMKPGSCGVPFFGHDLAVVDEQGREVPDGVPGYLVIRRPFPSLARDVYGDRNLYLNAYFSRMPGLYFTGDSAVRDADGHFWVLGRVDDVINVSGHRISTMEMESSLIQHPAVVEAAVVGEPDDVKGQVPVAFVTLERGWEPSTDLEEELKARVVADIGSFARPARVYFVEAMPKTRSGKILRRMLREILQTGEVKGDVTGLEDWEVVERLLHDLRERAPGGE

SEQ ID NO: 420 - protein, 662 aa, Artificial
  Substituion in SEQ ID NO 409
MRRDPRGRRSVEHDRERPAHPATGGLRGPVLSLELRRVPREISSVHRRSGGILGRDRRRVGMAAARKDGHRGRASRFSVLSRKLHQRVRKLRGSTSQAPDVRNKVALFFEGEDGERRSVTYLQLQDAVSRFANALKDLGLRQGDVVCVYMQNLIETYVALLACLRIGVLYNTVFAGFSAEALRERIVRCGAKAVICANGSLRRGRVLRLKETVDRALEGVETVEHVIVYRRLPDLDTPMTPGRDLDFESLVERASRDCPPAVLEANEPAFLIFTSGTTGRPKGIVHAGGGFLLGTYAYTKYQLDLRPEDVYWNTADIGWLTSHIFVLVGGLALGTTTILYEGALDWPKSGRLYEMIERYRVNKLFSAPTAYRMMMKHGEDIARQYDLSSLELLVSVGEPFNPEAWHWVRRVVGGDVAVIQNTWGQTETGGTPLALLPGAVPMKPGSCGVPFFGHDLAVVDEQGREVPDGVPGYLVIRRPFPSLARDVYGDRNLYLNAYFSRMPGLYFTGDSAVRDADGHFWVLGRVDDVINVSGHRISTMEMESSLIQHPAVVEAAVVGEPDDVKGQVPVAFVTLERGWEPSTDLEEELKARVVADIGSFARPARVYFVEAMPKTRSGKILRRMLREILQTGEVKGDVTGLEDWEVVERLLHDLRERAPGGE

SEQ ID NO: 421 - DNA, 1989 bp, Artificial
  Substituion in SEQ ID NO 410
ttgaggagggatcctcgtggcagacgaagtgttgagcatgatcgcgagcgcccggctcatcccgccaccggaggcctacgcggcccggtcttatctctcgagctacgacgagtaccgcgcgagatatcaagcgtccatcgacgatccggcggcattctgggacgagatcgccgacgagttggtatggcagcagcgcggaaagacggtcatcgcgggcgagcttcccgattttcagttctttcccggaagttacatcaacgtgtgcgaaaactgcgtggatcgacaagccaagcacccgatgtacgcaacaaggtggcgctcttcttcgagggggaggacggcgaacgccgcagcgtgacgtacctccagctccaggatgccgtgtcccggtttgcgaacgcgctcaaagatctcgggctgcgacagggcgatgtggtctgcgtgtacatgcaaaatctcatcgagacctacgtcgcgctcttggcgtgcctgcgcatcggcgtgctctacaacacggtgtttgcgggattttccgccgaggcgctgcgcgagcggattgtgcggtgcggggccaaggcggtgatctgcgccaacggaagtctcaggcgcggccgggtgcttcggctgaaggaaaccgtcgaccgggcgcttgaaggtgtggagaccgtggagcacgtcatcgtctaccggcgcctgcccgatctcgacacgccgatgacgccggggcgcgatctcgactttgagtcgctcgtcgagcgcgcctcccgggactgccctcctgctgtactggaggcgaacgagcccgccttcctcatcttcacgagcggaacgacgggccggccgaaaggcatcgtccacgccggcggcggatttctgcttggaacctacgcgtacacgaagtaccagctcgacctccggcccgaggacgtgtactggaacacagcggacatcggctggctcacatctcacatcttcgtgctggtcggcggtctcgccttaggcaccacgaccatcctgtacgagggcgcgctggattggcccaaatcgggcaggctatacgagatgatcgagcgataccgcgtcaacaaactgttctcggcacccaccgcctatcggatgatgatgaaacacggcgaggacatcgcgaaacaatacgacttgtcgtcgcttgaactcttggtgtcggtcggagagccgttcaatcccgaggcgtggcattgggtccgccgcgttgtcggcggtgacgtcgctgtcatcaacaacacctggggccagaccgagaccggtggaacgccgctcgcgctgttgccaggggcggtgcccatgaaacccggctcgtgtggcgtgccgttcttcggacacgatctcgccgtcgtggatgaacagggccgggaggtgccggacggggtgcccggatatctcgtgatccgccgtccgttcccgtcgctcgcgcgcgacgtgtacggcgatcggaacctgtacctgaacgcgtacttctcgcgtatgcccgggctctacttcacgggcgacagcgcggtccgggatgcggatggccacttctgggtgctcggccgggtcgacgacgtgatcaacgtgtcgggccaccgaatcagcacgatggagatggagagctcgctcatccagcatccggccgtggtggaggcggcggtcgtgggcgagcctgacgacgtgaagggccaggtccccgttgcgttcgtgacgctcgagcgcgggtgggaaccgagcacggacctggaggaggaactgaaggcgcgcgtcgtggcggacatcggttcgtttgcgcggccggcgcgcgtgtacttcgtggaggcgatgccgaagacgcgatcgggcaagatcctgcggcggatgctgcgcgagatcctgcagacgggcgaagtgaaaggggacgtcaccggcctggaggactgggaggtcgtggaacggcttctgcacgatttgcgcgagcgggcgccgggcggtgaatga

SEQ ID NO: 422 - DNA, 1989 bp, Artificial
  Substituion in SEQ ID NO 410
ttgaggagggatcctcgtggcagacgaagtgttgagcatgatcgcgagcgcccggctcatcccgccaccggaggcctacgcggcccggtcttatctctcgagctacgacgagtaccgcgcgagatatcaagcgtccatcgacgatccggcggcattctgggacgagatcgccgacgagttggtatggcagcagcgcggaaagacggtcatcgcgggcgagcttcccgattttcagttctttcccggaagttacatcaacgtgtgcgaaaactgcgtggatcgacaagccaagcacccgatgtacgcaacaaggtggcgctcttcttcgagggggaggacggcgaacgccgcagcgtgacgtacctccagctccaggatgccgtgtcccggtttgcgaacgcgctcaaagatctcgggctgcgacagggcgatgtggtctgcgtgtacatgcaaaatctcatcgagacctacgtcgcgctcttggcgtgcctgcgcatcggcgtgctctacaacacggtgtttgcgggattttccgccgaggcgctgcgcgagcggattgtgaaatgcggggccaaggcggtgatctgcgccaacggaagtctcaggcgcggccgggtgcttcggctgaaggaaaccgtcgaccgggcgcttgaaggtgtggagaccgtggagcacgtcatcgtctaccggcgcctgcccgatctcgacacgccgatgacgccggggcgcgatctcgactttgagtcgctcgtcgagcgcgcctcccgggactgccctcctgctgtactggaggcgaacgagcccgccttcctcatcttcacgagcggaacgacgggccggccgaaaggcatcgtccacgccggcggcggatttctgcttggaacctacgcgtacacgaagtaccagctcgacctccggcccgaggacgtgtactggaacacagcggacatcggctggctcacatctcacatcttcgtgctggtcggcggtctcgccttaggcaccacgaccatcctgtacgagggcgcgctggattggcccaaatcgggcaggctatacgagatgatcgagcgataccgcgtcaacaaactgttctcggcacccaccgcctatcggatgatgatgaaacacggcgaggacatcgcgcggcaatacgacttgtcgtcgcttgaactcttggtgtcggtcggagagccgttcaatcccgaggcgtggcattgggtccgccgcgttgtcggcggtgacgtcgctgtcatcaacaacacctggggccagaccgagaccggtggaacgccgctcgcgctgttgccaggggcggtgcccatgaaacccggctcgtgtggcgtgccgttcttcggacacgatctcgccgtcgtggatgaacagggccgggaggtgccggacggggtgcccggatatctcgtgatccgccgtccgttcccgtcgctcgcgcgcgacgtgtacggcgatcggaacctgtacctgaacgcgtacttctcgcgtatgcccgggctctacttcacgggcgacagcgcggtccgggatgcggatggccacttctgggtgctcggccgggtcgacgacgtgatcaacgtgtcgggccaccgaatcagcacgatggagatggagagctcgctcatccagcatccggccgtggtggaggcggcggtcgtgggcgagcctgacgacgtgaagggccaggtccccgttgcgttcgtgacgctcgagcgcgggtgggaaccgagcacggacctggaggaggaactgaaggcgcgcgtcgtggcggacatcggttcgtttgcgcggccggcgcgcgtgtacttcgtggaggcgatgccgaagacgcgatcgggcaagatcctgcggcggatgctgcgcgagatcctgcagacgggcgaagtgaaaggggacgtcaccggcctggaggactgggaggtcgtggaacggcttctgcacgatttgcgcgagcgggcgccgggcggtgaatga

SEQ ID NO: 423 - DNA, 1989 bp, Artificial
  Substituion in SEQ ID NO 410
ttgaggagggatcctcgtggcagacgaagtgttgagcatgatcgcgagcgcccggctcatcccgccaccggaggcctacgcggcccggtcttatctctcgagctacgacgagtaccgcgcgagttatcaagcgtccatcgacgatccggcggcattctgggacgagatcgccgacgagttggtatggcagcagcgcggaaagacggtcatcgcgggcgagcttcccgattttcagttctttcccggaagttacatcaacgtgtgcgaaaactgcgtggatcgacaagccaagcacccgatgtacgcaacaaggtggcgctcttcttcgagggggaggacggcgaacgccgcagcgtgacgtacctccagctccaggatgccgtgtcccggtttgcgaacgcgctcaaagatctcgggctgcgacagggcgatgtggtctgcgtgtacatgcaaaatctcatcgagacctacgtcgcgctcttggcgtgcctgcgcatcggcgtgctctacaacacggtgtttgcgggattttccgccgaggcgctgcgcgagcggattgtgcggtgcggggccaaggcggtgatctgcgccaacggaagtctcaggcgcggccgggtgcttcggctgaaggaaaccgtcgaccgggcgcttgaaggtgtggagaccgtggagcacgtcatcgtctaccggcgcctgcccgatctcgacacgccgatgacgccggggcgcgatctcgactttgagtcgctcgtcgagcgcgcctcccgggactgccctcctgctgtactggaggcgaacgagcccgccttcctcatcttcacgagcggaacgacgggccggccgaaaggcatcgtccacgccggcggcggatttctgcttggaacctacgcgtacacgaagtaccagctcgacctccggcccgaggacgtgtactggaacacagcggacatcggctggctcacatctcacatcttcgtgctggtcggcggtctcgccttaggcaccacgaccatcctgtacgagggcgcgctggattggcccaaatcgggcaggctatacgagatgatcgagcgataccgcgtcaacaaactgttctcggcacccaccgcctatcggatgatgatgaaacacggcgaggacatcgcgcggcaatacgacttgtcgtcgcttgaactcttggtgtcggtcggagagccgttcaatcccgaggcgtggcattgggtccgccgcgttgtcggcggtgacgtcgctgtcatcaacaacacctggggccagaccgagaccggtggaacgccgctcgcgctgttgccaggggcggtgcccatgaaacccggctcgtgtggcgtgccgttcttcggacacgatctcgccgtcgtggatgaacagggccgggaggtgccggacggggtgcccggatatctcgtgatccgccgtccgttcccgtcgctcgcgcgcgacgtgtacggcgatcggaacctgtacctgaacgcgtacttctcgcgtatgcccgggctctacttcacgggcgacagcgcggtccgggatgcggatggccacttctgggtgctcggccgggtcgacgacgtgatcaacgtgtcgggccaccgaatcagcacgatggagatggagagctcgctcatccagcatccggccgtggtggaggcggcggtcgtgggcgagcctgacgacgtgaagggccaggtccccgttgcgttcgtgacgctcgagcgcgggtgggaaccgagcacggacctggaggaggaactgaaggcgcgcgtcgtggcggacatcggttcgtttgcgcggccggcgcgcgtgtacttcgtggaggcgatgccgaagacgcgatcgggcaagatcctgcggcggatgctgcgcgagatcctgcagacgggcgaagtgaaaggggacgtcaccggcctggaggactgggaggtcgtggaacggcttctgcacgatttgcgcgagcgggcgccgggcggtgaatga

SEQ ID NO: 424 - DNA, 1989 bp, Artificial
  Substituion in SEQ ID NO 410
ttgaggagggatcctcgtggcagacgaagtgttgagcatgatcgcgagcgcccggctcatcccgccaccggaggcctacgcggcccggtcttatctctcgagctacgacgagtaccgcgcgagatatcaagcgtccatcgacgatccggcggcattctgggacgagatcgccgacgagttggtatggcagcagcgcggaaagacggtcatcgcgggcgagcttcccgattttcagttctttcccggaagttacatcaacgtgtgcgaaaactgcgtggatcgacaagccaagcacccgatgtacgcaacaaggtggcgctcttcttcgagggggaggacggcgaacgccgcagcgtgacgtacctccagctcaatgatgccgtgtcccggtttgcgaacgcgctcaaagatctcgggctgcgacagggcgatgtggtctgcgtgtacatgcaaaatctcatcgagacctacgtcgcgctcttggcgtgcctgcgcatcggcgtgctctacaacacggtgtttgcgggattttccgccgaggcgctgcgcgagcggattgtgcggtgcggggccaaggcggtgatctgcgccaacggaagtctcaggcgcggccgggtgcttcggctgaaggaaaccgtcgaccgggcgcttgaaggtgtggagaccgtggagcacgtcatcgtctaccggcgcctgcccgatctcgacacgccgatgacgccggggcgcgatctcgactttgagtcgctcgtcgagcgcgcctcccgggactgccctcctgctgtactggaggcgaacgagcccgccttcctcatcttcacgagcggaacgacgggccggccgaaaggcatcgtccacgccggcggcggatttctgcttggaacctacgcgtacacgaagtaccagctcgacctccggcccgaggacgtgtactggaacacagcggacatcggctggctcacatctcacatcttcgtgctggtcggcggtctcgccttaggcaccacgaccatcctgtacgagggcgcgctggattggcccaaatcgggcaggctatacgagatgatcgagcgataccgcgtcaacaaactgttctcggcacccaccgcctatcggatgatgatgaaacacggcgaggacatcgcgcggcaatacgacttgtcgtcgcttgaactcttggtgtcggtcggagagccgttcaatcccgaggcgtggcattgggtccgccgcgttgtcggcggtgacgtcgctgtcatcaacaacacctggggccagaccgagaccggtggaacgccgctcgcgctgttgccaggggcggtgcccatgaaacccggctcgtgtggcgtgccgttcttcggacacgatctcgccgtcgtggatgaacagggccgggaggtgccggacggggtgcccggatatctcgtgatccgccgtccgttcccgtcgctcgcgcgcgacgtgtacggcgatcggaacctgtacctgaacgcgtacttctcgcgtatgcccgggctctacttcacgggcgacagcgcggtccgggatgcggatggccacttctgggtgctcggccgggtcgacgacgtgatcaacgtgtcgggccaccgaatcagcacgatggagatggagagctcgctcatccagcatccggccgtggtggaggcggcggtcgtgggcgagcctgacgacgtgaagggccaggtccccgttgcgttcgtgacgctcgagcgcgggtgggaaccgagcacggacctggaggaggaactgaaggcgcgcgtcgtggcggacatcggttcgtttgcgcggccggcgcgcgtgtacttcgtggaggcgatgccgaagacgcgatcgggcaagatcctgcggcggatgctgcgcgagatcctgcagacgggcgaagtgaaaggggacgtcaccggcctggaggactgggaggtcgtggaacggcttctgcacgatttgcgcgagcgggcgccgggcggtgaatga

SEQ ID NO: 425 - DNA, 1989 bp, Artificial
  Substituion in SEQ ID NO 410
ttgaggagggatcctcgtggcagacgaagtgttgagcatgatcgcgagcgcccggctcatcccgccaccggaggcctacgcggcccggtcttatctctcgagctacgacgagtaccgcgcgagatatcaagcgtccatcgacgatccggcggcattctgggacgagatcgccgacgagttggtatggcagcagcgcggaaagacggtcatcgcgggcgagcttcccgattttcagttctttcccggaagttacatcaacgtgtgcgaaaactgcgtggatcgacaagccaagcacccgatgtacgcaacaaggtggcgctcttcttcgagggggaggacggcgaacgccgcagcgtgacgtacctccagctccaggatgccgtgtcccggtttgcgaacgcgctcaaagatctcgggctgcgacagggcgatgtggtctgcgtgtacatgcaaaatctcatcgagacctacgtcgcgctcttggcgtgcctgcgcatcggcgtgctctacaacacggtgtttgcgggattttccgccgaggcgctgcgcgagcggattgtgcggtgcggggccaaggcggtgatctgcgccaacggaagtctcaggcgcggccgggtgcttcggctgaaggaaaccgtcgaccgggcgcttgaaggtgtggagaccgtggagcacgtcatcgtctaccggcgcctgcccgatctcgacacgccgatgacgccggggcgcgatctcgactttgagtcgctcgtcgagcgcgcctcccgggactgccctcctgctgtactggaggcgaacgagcccgccttcctcatcttcacgagcggaacgacgggccggccgaaaggcatcgtccacgccggcggcggatttctgcttggaacctacgcgtacacgaagtaccagctcgacctccggcccgaggacgtgtactggaacacagcggacatcggctggctcacatctcacatcttcgtgctggtcggcggtctcgccttaggcaccacgaccatcctgtacgagggcgcgctggattggcccaaatcgggcaggctatacgagatgatcgagcgataccgcgtcaacaaactgttctcggcacccaccgcctatcggatgatgatgaaacacggcgaggacatcgcgcggcaatacgacttgtcgtcgcttgaactcttggtgtcggtcggagagccgttcaatcccgaggcgtggcattgggtccgccgcgttgtcggcggtgacgtcgctgtcatccaaaacacctggggccagaccgagaccggtggaacgccgctcgcgctgttgccaggggcggtgcccatgaaacccggctcgtgtggcgtgccgttcttcggacacgatctcgccgtcgtggatgaacagggccgggaggtgccggacggggtgcccggatatctcgtgatccgccgtccgttcccgtcgctcgcgcgcgacgtgtacggcgatcggaacctgtacctgaacgcgtacttctcgcgtatgcccgggctctacttcacgggcgacagcgcggtccgggatgcggatggccacttctgggtgctcggccgggtcgacgacgtgatcaacgtgtcgggccaccgaatcagcacgatggagatggagagctcgctcatccagcatccggccgtggtggaggcggcggtcgtgggcgagcctgacgacgtgaagggccaggtccccgttgcgttcgtgacgctcgagcgcgggtgggaaccgagcacggacctggaggaggaactgaaggcgcgcgtcgtggcggacatcggttcgtttgcgcggccggcgcgcgtgtacttcgtggaggcgatgccgaagacgcgatcgggcaagatcctgcggcggatgctgcgcgagatcctgcagacgggcgaagtgaaaggggacgtcaccggcctggaggactgggaggtcgtggaacggcttctgcacgatttgcgcgagcgggcgccgggcggtgaatga

SEQ ID NO: 426 - protein, 377 aa, Alicyclobacillus acidocaldarius
MDFDLTSEQKMIRDTVREFAEAEIAPHAAEWDRTEHFPIEVFRKMGELGFLGLPIPEEYGGAGADMISYCLAVEEIGRACGGTGLSYEAHVSLACTPILLYGTEEQKQKYLVPMARGEALGAFGLTEPGAGSDAGGTRTTAVLEGDEWVITGNKIFNTNGGYAKYVVLTAVTDPASRGISAFIVPTDAEGFSVSKPYEKLGMRASNTVELILDHVRVPKENLLGPLNAGFKQFLSTLDGGRVAIAALAVGIARAAFETALAYAKTRVQFGQAISKFQAIQHKLADMAMHIDLARNAVMKAAWLKDQGRPYTLEASYAKLFASEMCTRTCEQAIQILGGYGYMREYPVERHYRDAKLIEIGEGTSEIQRLVIARQLGC

SEQ ID NO: 427 - DNA, 1134 bp, Alicyclobacillus acidocaldarius
gtggactttgatctcacctcggaacaaaagatgattcgggatacggtgcgcgagtttgcggaggccgagatcgcgcctcacgccgcggaatgggataggacggagcacttccccatcgaggtgtttcgcaagatgggcgaactcggctttctcggcctgcccattccggaggaatacggtggcgcgggcgccgacatgatctcgtactgcctggcggtggaggagatcgggcgcgcgtgcggcggaacagggctcagctacgaggcgcacgtgtcgctcgcgtgcacgcccattctgctctacgggacggaggagcagaaacagaagtacctggtgcctatggcgcgcggcgaggcgctcggtgcgtttggtttgacggagcccggggctggatcggacgccggaggaacgcggacgaccgccgtcctggagggcgacgaatgggtcatcaccggcaacaagatcttcaacacaaacggcggctatgcgaagtacgtcgtgctcaccgcggtgacggatccggcgtcgcgcggcatcagcgcgttcatcgtgccgacagatgccgagggcttctcggtgagcaagccgtatgagaaactgggcatgcgggcgtcgaacacggtcgaactgattctcgatcacgtccgcgttccgaaggagaacctactcgggccgctgaacgctgggttcaagcagtttctctcgacgctggacggcggacgtgtcgccatcgcagctctggcggtcgggatcgcgcgggcggcgtttgagacggctctcgcgtacgccaagacgcgcgtccagttcgggcaggccatcagcaagttccaggcgattcagcacaagctcgccgacatggccatgcacatcgatctcgcccggaatgcggtgatgaaggccgcgtggctgaaggatcagggccggccgtacacgctggaggcgtcgtacgccaagctgtttgcgtccgagatgtgcacgcggacgtgcgagcaggcgattcagatcttgggcgggtatggctacatgcgcgaatacccggtggagcgccactatcgcgacgcgaagttgatcgagatcggcgagggcacgtcggagatccagcgcctggtgatcgcgcgccagctgggctgttag

SEQ ID NO: 428 - protein, 380 aa, Geobacillus kaustophilus HTA426
MNFSLTKEQQMIKEMVRDFAEKEIAPYAAKWDEEAHFPLDVFRKMGELGLLGLPFPEEYGGAGGDTISYAIAVEEIGRACGGTGLSYAAAVSLGASPIYYFGTEEQKQKWLVPMAKGETLGAFGLTEPNAGSDAGGTRTTAVLDGDEYVINGEKCWITNAQYARQVIVTAVTGKDARGKNIITALIVPTDSPGFTIRSNYDKMGVRASNTCELVFENVRVPKENVLGDPQKGFKQFLYTLDGGRISIAALAVGIAQAAFEKALQYAKERVQFGQPISKFQAIQFKLADMAMEIELARNMVYKAAWLKDQGKPFTKEASFAKLFASEMGFRVCNQAIQIHGGYGYMKEYGVERHLRDIKLMEIGEGTSEIQRLVIARQLGC

SEQ ID NO: 429 - protein, 380 aa, Geobacillus thermodenitrificans NG80-2
MDFSLTKEQQMIKEMVRDFAEKEIAPYAAKWDEEAYFPREVFRKMGELGLLGLPFPESYGGAGGDTISYAIAVEEIGRACGGTGLSYAAAVSLGASPIYYFGSEEQKQTWLVPMAKGETLGAFGLTEPNAGSDAGGTRTTAVLDGDEYVINGEKCWITNAQYARQVIVTAVTGKDARGKNIITALIVPTDSPGFTIRSNYDKMGVRASNTCELVFENVRVPKENVLGDPQKGFKQFLYTLDGGRISIAALAVGIAQAAFEKALQYAKERVQFGQSISKFQAIQFKLADMAMEIELARNMVYKAAWLKDQGKPFTKEASFAKLFASEMGFRVCNQAIQIHGGYGYMKEYGVERHLRDIKLMEIGEGTSEIQRLVIARQLGC

SEQ ID NO: 430 - protein, 380 aa, Bacillus coagulans 36D1
MDFELSKEQIMLQEMVRDFAEKEIEPYAREVDETGKMRMETFQKLGNLGLLGIPFPEKYGGAGGDTISYCIAVEEIGKACGGTGLSYAANTSLGASPIYYFGTEEQKQKWLVPMAKGEALGAFGLTEPNAGSDAGGTRTKAVLDGDEWVINGEKCWITNAEYARQVIVTAVTGKRENGRNIISAIIVPADAPGVAITSPYEKMGVRGSNTCQIVLENVRVPRENLLGDENKGFSQFLYTLDGGRISIAALSVGIAQAAFEKALRYAKERMQFGQAISKFQAIQFKLADMAMEIDLARNAVYKAAWLKDQGKPFSKEAAYAKLFASEMGFRVCNQAIQIHGGSGYMREYGVERHLRDIKLMEIGEGTSEIQRLVIARKLGC

SEQ ID NO: 431 - protein, 380 aa, Bacillus halodurans C-125
MNFELTKEQQMVRDMVRDFAENEIAPNAIHYDKTAQFPEDVFKKMGELGLLGIPFPEEYGGSGGDTISYALAVEEVGRACGGTGLSYAAAVSLGASPIYYFGTERQKQEHLVPLATGESLGSFGLTEPNAGSDAGGTRTKAVLEGDEYVINGEKCWITNAGYARTVIVTAVTGKDERGKPVISALIVPTGIEGFTISCNYDKMGVRASNTCELVLEDVRVPKENLLGDPTKGFKQFLYTLDGGRISIGALAVGIAQAAFDRALAYANERKQFGQKISSFQAIQFKLADMAMEIELARNMVLKAAWLKDQKKPFTKEGAYAKLYASETAMRTANQAIQIHGGYGYMQEYEVERMLRDAKLLEIGEGTSEIQRMVIARQLGC

SEQ ID NO: 432 - protein, 379 aa, Bacillus licheniformis ATCC 14580
MNFELTREQQMIRELARDFAKQEIAPHAEHVDRTGEFPIETFKKMGELGLLGIPFPESYGGSGGDTISYALSVEEIGKACGSTGLSYAAAVSLGAAPIYYFGTEEQKQEYLVPLATGRALGAFGLTEPNAGSDAGGTRTKARSEGDSYVISGEKCWITNAGFARTVIVTAVTGIDDNGKNIISAIIVPTDSEGFTIKSEYDKMGVRGSNTSQLILDNVRVPKQNLLGSPEKGFKQFLNTLDGGRISIAALAVGIAQGAFEAALTYARERKQFGRPISYFQAIQFKLADMAMEIELARNMVLKAAWLKDQGRPFTKEAAFAKLYASEMAFRTCNQSIQIHGGYGYMKEYGVERMLRDAKLMEIGEGTSEIQRLVIARQLG

SEQ ID NO: 433 - protein, 377 aa, Artificial
  Substituion in SEQ ID NO 426
MDFDLTSEQKMIRDTVREFAEAEIAPHAAEWDRTEHFPIEVFRKMGELGFLGLPIPEEYGGAGADMISYCLAVEEIGRACGGTGLSYEAHVSLACTPILLYGTEEQKQKYLVPMARGEALGAFGLTEPGAGSDAGGTRTTAVLEGDEWVITGNKIFNTNGGYAKYVVLTAVTDPASRGISAFIVPTDAEGFSVSRPYEKLGMRASNTVELILDHVRVPKENLLGPLNAGFKQFLSTLDGGRVAIAALAVGIARAAFETALAYAKTRVQFGQAISKFQAIQHKLADMAMHIDLARNAVMKAAWLKDQGRPYTLEASYAKLFASEMCTRTCEQAIQILGGYGYMREYPVERHYRDAKLIEIGEGTSEIQRLVIARQLGC

SEQ ID NO: 434 - protein, 377 aa, Artificial
  Substituion in SEQ ID NO 426
MDFDLTSEQKMIRDTVREFAEAEIAPHAAEWDRTEHFPIEVFRKMGELGFLGLPIPEEYGGAGADMISYCLAVEEIGRACGGTGLSYEAHVSLACTPILLYGTEEQKQKYLVPMARGEALGAFGLTEPGAGSDAGGTRTTAVIEGDEWVITGNKIFNTNGGYAKYVVLTAVTDPASRGISAFIVPTDAEGFSVSKPYEKLGMRASNTVELILDHVRVPKENLLGPLNAGFKQFLSTLDGGRVAIAALAVGIARAAFETALAYAKTRVQFGQAISKFQAIQHKLADMAMHIDLARNAVMKAAWLKDQGRPYTLEASYAKLFASEMCTRTCEQAIQILGGYGYMREYPVERHYRDAKLIEIGEGTSEIQRLVIARQLGC

SEQ ID NO: 435 - protein, 377 aa, Artificial
  Substituion in SEQ ID NO 426
MDFDLTSEQKMIRDTVREFAEAEIAPHAAEWDRTEHFPIEVFRKMGELGFLGLPIPEEYGGAGADMISYCLAVEEIGRACGGTGLSYEAHVSLACTPILLYGTEEQKQKYLVPMARGEALGAFGLTEPGAGSDAGGTRTTAVLEGDEWVITGNKIFNTNGGYAKYVVLTAVTDPASRGISAFIVPTDAEGFSVSKPYEKLGMRASNTIELILDHVRVPKENLLGPLNAGFKQFLSTLDGGRVAIAALAVGIARAAFETALAYAKTRVQFGQAISKFQAIQHKLADMAMHIDLARNAVMKAAWLKDQGRPYTLEASYAKLFASEMCTRTCEQAIQILGGYGYMREYPVERHYRDAKLIEIGEGTSEIQRLVIARQLGC

SEQ ID NO: 436 - protein, 377 aa, Artificial
  Substituion in SEQ ID NO 426
MDFDLTSEQKMIRDTVREFAEAEIAPHAAEWDRTEHFPIEVFRKMGELGFLGLPIPEEYGGAGADMISYCLAVEEIGRACGGTGLSYEAHVSLACTPILLYGTEEQKQKYLVPMARGEALGAFGLTEPGAGSDAGGTRTTAVLEGDEWVITGNKIFNTNGGYAKYVVLTAVTDPASRGISAFIVPTDAEGFSVSKPYEKLGMRASNTVELILDHVRVPKENLLGPINAGFKQFLSTLDGGRVAIAALAVGIARAAFETALAYAKTRVQFGQAISKFQAIQHKLADMAMHIDLARNAVMKAAWLKDQGRPYTLEASYAKLFASEMCTRTCEQAIQILGGYGYMREYPVERHYRDAKLIEIGEGTSEIQRLVIARQLGC

SEQ ID NO: 437 - protein, 377 aa, Artificial
  Substituion in SEQ ID NO 426
MDFDLTSEQKMIRDTVREFAEAEIAPHAAEWDRTEHFPIEVFRKMGELGFLGLPIPEEYGGAGADMISYCLAVEEIGRACGGTGLSYEAHVSLACTPILLYGTEEQKQKYLVPMARGEALGAFGLTEPGAGSDAGGTRTTAVLEGDEWVITGNKLFNTNGGYAKYVVLTAVTDPASRGISAFIVPTDAEGFSVSKPYEKLGMRASNTVELILDHVRVPKENLLGPLNAGFKQFLSTLDGGRVAIAALAVGIARAAFETALAYAKTRVQFGQAISKFQAIQHKLADMAMHIDLARNAVMKAAWLKDQGRPYTLEASYAKLFASEMCTRTCEQAIQILGGYGYMREYPVERHYRDAKLIEIGEGTSEIQRLVIARQLGC

SEQ ID NO: 438 - DNA, 1134 bp, Artificial
  Substituion in SEQ ID NO 427
gtggactttgatctcacctcggaacaaaagatgattcgggatacggtgcgcgagtttgcggaggccgagatcgcgcctcacgccgcggaatgggataggacggagcacttccccatcgaggtgtttcgcaagatgggcgaactcggctttctcggcctgcccattccggaggaatacggtggcgcgggcgccgacatgatctcgtactgcctggcggtggaggagatcgggcgcgcgtgcggcggaacagggctcagctacgaggcgcacgtgtcgctcgcgtgcacgcccattctgctctacgggacggaggagcagaaacagaagtacctggtgcctatggcgcgcggcgaggcgctcggtgcgtttggtttgacggagcccggggctggatcggacgccggaggaacgcggacgaccgccgtcctggagggcgacgaatgggtcatcaccggcaacaagatcttcaacacaaacggcggctatgcgaagtacgtcgtgctcaccgcggtgacggatccggcgtcgcgcggcatcagcgcgttcatcgtgccgacagatgccgagggcttctcggtgagccgtccgtatgagaaactgggcatgcgggcgtcgaacacggtcgaactgattctcgatcacgtccgcgttccgaaggagaacctactcgggccgctgaacgctgggttcaagcagtttctctcgacgctggacggcggacgtgtcgccatcgcagctctggcggtcgggatcgcgcgggcggcgtttgagacggctctcgcgtacgccaagacgcgcgtccagttcgggcaggccatcagcaagttccaggcgattcagcacaagctcgccgacatggccatgcacatcgatctcgcccggaatgcggtgatgaaggccgcgtggctgaaggatcagggccggccgtacacgctggaggcgtcgtacgccaagctgtttgcgtccgagatgtgcacgcggacgtgcgagcaggcgattcagatcttgggcgggtatggctacatgcgcgaatacccggtggagcgccactatcgcgacgcgaagttgatcgagatcggcgagggcacgtcggagatccagcgcctggtgatcgcgcgccagctgggctgttag

SEQ ID NO: 439 - DNA, 1134 bp, Artificial
  Substituion in SEQ ID NO 427
gtggactttgatctcacctcggaacaaaagatgattcgggatacggtgcgcgagtttgcggaggccgagatcgcgcctcacgccgcggaatgggataggacggagcacttccccatcgaggtgtttcgcaagatgggcgaactcggctttctcggcctgcccattccggaggaatacggtggcgcgggcgccgacatgatctcgtactgcctggcggtggaggagatcgggcgcgcgtgcggcggaacagggctcagctacgaggcgcacgtgtcgctcgcgtgcacgcccattctgctctacgggacggaggagcagaaacagaagtacctggtgcctatggcgcgcggcgaggcgctcggtgcgtttggtttgacggagcccggggctggatcggacgccggaggaacgcggacgaccgccgtcattgagggcgacgaatgggtcatcaccggcaacaagatcttcaacacaaacggcggctatgcgaagtacgtcgtgctcaccgcggtgacggatccggcgtcgcgcggcatcagcgcgttcatcgtgccgacagatgccgagggcttctcggtgagcaagccgtatgagaaactgggcatgcgggcgtcgaacacggtcgaactgattctcgatcacgtccgcgttccgaaggagaacctactcgggccgctgaacgctgggttcaagcagtttctctcgacgctggacggcggacgtgtcgccatcgcagctctggcggtcgggatcgcgcgggcggcgtttgagacggctctcgcgtacgccaagacgcgcgtccagttcgggcaggccatcagcaagttccaggcgattcagcacaagctcgccgacatggccatgcacatcgatctcgcccggaatgcggtgatgaaggccgcgtggctgaaggatcagggccggccgtacacgctggaggcgtcgtacgccaagctgtttgcgtccgagatgtgcacgcggacgtgcgagcaggcgattcagatcttgggcgggtatggctacatgcgcgaatacccggtggagcgccactatcgcgacgcgaagttgatcgagatcggcgagggcacgtcggagatccagcgcctggtgatcgcgcgccagctgggctgttag

SEQ ID NO: 440 - DNA, 1134 bp, Artificial
  Substituion in SEQ ID NO 427
gtggactttgatctcacctcggaacaaaagatgattcgggatacggtgcgcgagtttgcggaggccgagatcgcgcctcacgccgcggaatgggataggacggagcacttccccatcgaggtgtttcgcaagatgggcgaactcggctttctcggcctgcccattccggaggaatacggtggcgcgggcgccgacatgatctcgtactgcctggcggtggaggagatcgggcgcgcgtgcggcggaacagggctcagctacgaggcgcacgtgtcgctcgcgtgcacgcccattctgctctacgggacggaggagcagaaacagaagtacctggtgcctatggcgcgcggcgaggcgctcggtgcgtttggtttgacggagcccggggctggatcggacgccggaggaacgcggacgaccgccgtcctggagggcgacgaatgggtcatcaccggcaacaagatcttcaacacaaacggcggctatgcgaagtacgtcgtgctcaccgcggtgacggatccggcgtcgcgcggcatcagcgcgttcatcgtgccgacagatgccgagggcttctcggtgagcaagccgtatgagaaactgggcatgcgggcgtcgaacacgattgaactgattctcgatcacgtccgcgttccgaaggagaacctactcgggccgctgaacgctgggttcaagcagtttctctcgacgctggacggcggacgtgtcgccatcgcagctctggcggtcgggatcgcgcgggcggcgtttgagacggctctcgcgtacgccaagacgcgcgtccagttcgggcaggccatcagcaagttccaggcgattcagcacaagctcgccgacatggccatgcacatcgatctcgcccggaatgcggtgatgaaggccgcgtggctgaaggatcagggccggccgtacacgctggaggcgtcgtacgccaagctgtttgcgtccgagatgtgcacgcggacgtgcgagcaggcgattcagatcttgggcgggtatggctacatgcgcgaatacccggtggagcgccactatcgcgacgcgaagttgatcgagatcggcgagggcacgtcggagatccagcgcctggtgatcgcgcgccagctgggctgttag

SEQ ID NO: 441 - DNA, 1134 bp, Artificial
  Substituion in SEQ ID NO 427
gtggactttgatctcacctcggaacaaaagatgattcgggatacggtgcgcgagtttgcggaggccgagatcgcgcctcacgccgcggaatgggataggacggagcacttccccatcgaggtgtttcgcaagatgggcgaactcggctttctcggcctgcccattccggaggaatacggtggcgcgggcgccgacatgatctcgtactgcctggcggtggaggagatcgggcgcgcgtgcggcggaacagggctcagctacgaggcgcacgtgtcgctcgcgtgcacgcccattctgctctacgggacggaggagcagaaacagaagtacctggtgcctatggcgcgcggcgaggcgctcggtgcgtttggtttgacggagcccggggctggatcggacgccggaggaacgcggacgaccgccgtcctggagggcgacgaatgggtcatcaccggcaacaagatcttcaacacaaacggcggctatgcgaagtacgtcgtgctcaccgcggtgacggatccggcgtcgcgcggcatcagcgcgttcatcgtgccgacagatgccgagggcttctcggtgagcaagccgtatgagaaactgggcatgcgggcgtcgaacacggtcgaactgattctcgatcacgtccgcgttccgaaggagaacctactcgggccgattaacgctgggttcaagcagtttctctcgacgctggacggcggacgtgtcgccatcgcagctctggcggtcgggatcgcgcgggcggcgtttgagacggctctcgcgtacgccaagacgcgcgtccagttcgggcaggccatcagcaagttccaggcgattcagcacaagctcgccgacatggccatgcacatcgatctcgcccggaatgcggtgatgaaggccgcgtggctgaaggatcagggccggccgtacacgctggaggcgtcgtacgccaagctgtttgcgtccgagatgtgcacgcggacgtgcgagcaggcgattcagatcttgggcgggtatggctacatgcgcgaatacccggtggagcgccactatcgcgacgcgaagttgatcgagatcggcgagggcacgtcggagatccagcgcctggtgatcgcgcgccagctgggctgttag

SEQ ID NO: 442 - DNA, 1134 bp, Artificial
  Substituion in SEQ ID NO 427
gtggactttgatctcacctcggaacaaaagatgattcgggatacggtgcgcgagtttgcggaggccgagatcgcgcctcacgccgcggaatgggataggacggagcacttccccatcgaggtgtttcgcaagatgggcgaactcggctttctcggcctgcccattccggaggaatacggtggcgcgggcgccgacatgatctcgtactgcctggcggtggaggagatcgggcgcgcgtgcggcggaacagggctcagctacgaggcgcacgtgtcgctcgcgtgcacgcccattctgctctacgggacggaggagcagaaacagaagtacctggtgcctatggcgcgcggcgaggcgctcggtgcgtttggtttgacggagcccggggctggatcggacgccggaggaacgcggacgaccgccgtcctggagggcgacgaatgggtcatcaccggcaacaagttattcaacacaaacggcggctatgcgaagtacgtcgtgctcaccgcggtgacggatccggcgtcgcgcggcatcagcgcgttcatcgtgccgacagatgccgagggcttctcggtgagcaagccgtatgagaaactgggcatgcgggcgtcgaacacggtcgaactgattctcgatcacgtccgcgttccgaaggagaacctactcgggccgctgaacgctgggttcaagcagtttctctcgacgctggacggcggacgtgtcgccatcgcagctctggcggtcgggatcgcgcgggcggcgtttgagacggctctcgcgtacgccaagacgcgcgtccagttcgggcaggccatcagcaagttccaggcgattcagcacaagctcgccgacatggccatgcacatcgatctcgcccggaatgcggtgatgaaggccgcgtggctgaaggatcagggccggccgtacacgctggaggcgtcgtacgccaagctgtttgcgtccgagatgtgcacgcggacgtgcgagcaggcgattcagatcttgggcgggtatggctacatgcgcgaatacccggtggagcgccactatcgcgacgcgaagttgatcgagatcggcgagggcacgtcggagatccagcgcctggtgatcgcgcgccagctgggctgttag

SEQ ID NO: 443 - protein, 260 aa, Alicyclobacillus acidocaldarius
MEQPIVWQKAEDGIAELLLNRPDAMNALNYALLRALEDAVREIAEDRGVRAVIVRGEGKGFCAGADLKERRGLAPHEVRRNVRLTREAFDRVARLPQPTIAVLHGFAFGGGLELALACDFRIGSRDLRLGLTETSLAIVPGAGGTQRLARLIGPTWAKWMIFTAARIDAERARELGILLEVADTREAAMDAARALARAIAENGPVAVRQAKWAIDRGLDVDLSTGLAIEDAAYEGVLPTSDRLEALAAFAEKRKPHFRGE

SEQ ID NO: 444 - DNA, 783 bp, Alicyclobacillus acidocaldarius
gtggaacagccgattgtgtggcagaaggcggaggacgggatcgcggagctcctcctgaatcggccggatgcgatgaacgcgctcaattacgcgctgctccgcgcgctggaagatgccgtgcgcgagatcgcggaggaccgcggcgtgcgtgccgtgatcgtgcgcggggagggaaagggattctgcgcgggagcggatttgaaggaacggcgcggcctggcgcctcacgaagtgcggcgcaacgtgcgcttgacgcgcgaggcgttcgatcgcgtcgcgcgcctgccgcagccgaccatcgcggtcctgcatggattcgcgttcggaggcgggctggagctggcgctggcgtgcgactttcgcatcggcagtcgcgatcttcggctcggtctgacggagacgtcgctcgccatcgtccctggggcgggcgggacgcagcggctggcccgcctcatcgggccgacgtgggccaagtggatgatcttcacggccgcgcgcatcgacgcggagcgcgcgagagagctcggcatcctgctcgaggtggcggatacccgagaggccgcgatggacgccgcgcgagcgctggcccgcgccatcgccgaaaacgggccggtcgcggtgcgccaggcgaagtgggccatcgatcgcggcctggacgtcgatctgtcgacggggcttgccatcgaggatgcggcgtatgagggcgttctgccgacctcggatcggctggaggcgctcgcggcgttcgcggaaaagcgcaagccgcacttccgcggtgaatag

SEQ ID NO: 445 - protein, 249 aa, Exiguobacterium sibiricum 255-15
DHVAVIRVDRPERLNCFDYPTLVELKELVATVRREPDIRVVLFTGTGKAFSAGADLKERVTLNETEVRRNVEMIRDVFADIARLPQPTIAAVNGHALGGGFEWMLACDFRIIVNGALVGLTETSFGIIPGAGGTQRLPRLIGETRAKEMIFTAKKIDAETAERYGIVSRVVPTVEELMEVCLAFADEMLRNGPIAIRQAKQAIDQGLDHTLSEGLKLETAAYETVIPTEDRLEALRAFAEKRTPQFQGK

SEQ ID NO: 446 - protein, 260 aa, Desulfatibacillum alkenivorans AK-01
MEEELVLSQTEDQVLTLTLNRPKVMNSFNFAMLHALKAAVDKARFDPEVRVIIITGAGDRAFCAGADLKERATLTPVQVKEFIYTIRNLFTDIENLPKPVIAAVNGIALGGGTELALGCDIRLAAETAAMGLTETTLAIIPGAGGTQRLPRLIGKGKAKELIFTGRRVDAQEALDLGMVNKVVPGDSLLDAAKDMAAAIRKNGPIAVTQAKYAINQGMETDLSTGLAIESNAYWITIPSKDRLEGLAAFREKRKPVYKGE

SEQ ID NO: 447 - protein, 255 aa, Bacillus halodurans C-125
VLQTIKNHVAIITFNRPDQLNCFNYQMLLDLEQVIQEVKANPAIRTVIFTGAGGKSFSAGADLKERRTLDENQVRRNVNKIRSVFNQIEELPQPTIAAINGYALGGGFELALACDFRLAVPEAKMGLTEVTWAIIPGAGGTQRLPRLIGSQRAKEMILTGRKVAAEEAQRLGIILEVCDSKHLLTEAVRLAEKMSVNGPLAVIQAKYAIHYGCQTDLHTGLAIEAKAYETIIPTEDRLEALQAFKEKRPPQFKGK

SEQ ID NO: 448 - protein, 249 aa, Bacillus coagulans 36D1
QDGIAVMTLNRSEAANALSKEMLSDMHEVLSEIKKDRSTRVVILTGAGEKVFCAGADLKERKGMNEEEVLQAVRKIGAVVNETAALPQPVIAALNGSAFGGGLELALACDLRIGAREAKYGLTETSLAIIPGAGGTQRLPRLIGVGKAKELIYTARRLTAEEAAAIGLLEYAVPRAAVIEKAFELAGEMQKNGPIALRQAKTAIDQGTETGLSAGLKIEELAYNALIPTEDRLEGLRAFAEKRTPVYKG

SEQ ID NO: 449 - protein, 255 aa, Bacillus halodurans
VLQTIKNHVAIITFNRPDQLNCFNYQMLLDLEQVIQEVKANPAIRTVIFTGAGGKSFSAGADLKERRTLDENQVRRNVNKIRSVFNQIEELPQPTIAAINGYALGGGFELALACDFRLAVPEAKMGLTEVTWAIISGAGGTQRLPRLIGSQRAKEMILTGRKVAAEEAQRLGIILEVCDSKHLLTEAVRLAEKMSVNGPLAVIQAKYAIHYGCQTDLHTGLAIEAKAYETIIPTEDRLEALQAFKEKRPPQFKGK

SEQ ID NO: 450 - protein, 260 aa, Artificial
  Substituion in SEQ ID NO 443
MEQPIVWQKAEDGIAELLLNRPDAMNALNYALLRALEDAVREIAEDRGVRAVIVRGEGKGFCAGADLKERRGLAPHEVRRNVRLTREAFDRVARLPQPTIAVLHGFAFGGGLELALACDFRIGSRDLRLGLTETSLAIVPGAGGTQRLARLIGPTWAKWMIFTAARIDAERARELGILLEVADTREAAMDAARALARAIAENGPVAVRQAKWAIDRGLDVDLSTGLAIEDAAYEGVLPTSDRLEALAAFAEKRKPHFRGD

SEQ ID NO: 451 - protein, 260 aa, Artificial
  Substituion in SEQ ID NO 443
MEQPIVWQKAEDGIAELLLNRPDAMNALNYALLRALEDAVREIAEDRGVRAVIVRGEGKGFCAGADLKERRGLAPHEVRRNVRLTREAFDRVARLPQPTIAVLHGFAFGGGLELALACDFRIGSRDLRLGLTETSIAIVPGAGGTQRLARLIGPTWAKWMIFTAARIDAERARELGILLEVADTREAAMDAARALARAIAENGPVAVRQAKWAIDRGLDVDLSTGLAIEDAAYEGVLPTSDRLEALAAFAEKRKPHFRGE

SEQ ID NO: 452 - protein, 260 aa, Artificial
  Substituion in SEQ ID NO 443
MEQPIVWQKAEDGIAELLLNRPDAMNALNYALLRALEDAVREIAEDRGVRAVIVRGEGKGFCAGADLKERRGLAPHEVRRNVRLTREAFDRVARLPQPTIAVLHGFAFGGGLELALACDFRIGSRELRLGLTETSLAIVPGAGGTQRLARLIGPTWAKWMIFTAARIDAERARELGILLEVADTREAAMDAARALARAIAENGPVAVRQAKWAIDRGLDVDLSTGLAIEDAAYEGVLPTSDRLEALAAFAEKRKPHFRGE

SEQ ID NO: 453 - protein, 260 aa, Artificial
  Substituion in SEQ ID NO 443
MEQPIVWQKAEDGIAELLLNRPDAMNALNYALLRALEDAVREIAEDRGVRAVIVRGEGKGFCAGADLKERRGLAPHEVRRNVRLTRDAFDRVARLPQPTIAVLHGFAFGGGLELALACDFRIGSRDLRLGLTETSLAIVPGAGGTQRLARLIGPTWAKWMIFTAARIDAERARELGILLEVADTREAAMDAARALARAIAENGPVAVRQAKWAIDRGLDVDLSTGLAIEDAAYEGVLPTSDRLEALAAFAEKRKPHFRGE

SEQ ID NO: 454 - protein, 260 aa, Artificial
  Substituion in SEQ ID NO 443
MEQPLVWQKAEDGIAELLLNRPDAMNALNYALLRALEDAVREIAEDRGVRAVIVRGEGKGFCAGADLKERRGLAPHEVRRNVRLTREAFDRVARLPQPTIAVLHGFAFGGGLELALACDFRIGSRDLRLGLTETSLAIVPGAGGTQRLARLIGPTWAKWMIFTAARIDAERARELGILLEVADTREAAMDAARALARAIAENGPVAVRQAKWAIDRGLDVDLSTGLAIEDAAYEGVLPTSDRLEALAAFAEKRKPHFRGE

SEQ ID NO: 455 - DNA, 783 bp, Artificial
  Substituion in SEQ ID NO 444
gtggaacagccgattgtgtggcagaaggcggaggacgggatcgcggagctcctcctgaatcggccggatgcgatgaacgcgctcaattacgcgctgctccgcgcgctggaagatgccgtgcgcgagatcgcggaggaccgcggcgtgcgtgccgtgatcgtgcgcggggagggaaagggattctgcgcgggagcggatttgaaggaacggcgcggcctggcgcctcacgaagtgcggcgcaacgtgcgcttgacgcgcgaggcgttcgatcgcgtcgcgcgcctgccgcagccgaccatcgcggtcctgcatggattcgcgttcggaggcgggctggagctggcgctggcgtgcgactttcgcatcggcagtcgcgatcttcggctcggtctgacggagacgtcgctcgccatcgtccctggggcgggcgggacgcagcggctggcccgcctcatcgggccgacgtgggccaagtggatgatcttcacggccgcgcgcatcgacgcggagcgcgcgagagagctcggcatcctgctcgaggtggcggatacccgagaggccgcgatggacgccgcgcgagcgctggcccgcgccatcgccgaaaacgggccggtcgcggtgcgccaggcgaagtgggccatcgatcgcggcctggacgtcgatctgtcgacggggcttgccatcgaggatgcggcgtatgagggcgttctgccgacctcggatcggctggaggcgctcgcggcgttcgcggaaaagcgcaagccgcacttccgcggtgattag

SEQ ID NO: 456 - DNA, 783 bp, Artificial
  Substituion in SEQ ID NO 444
gtggaacagccgattgtgtggcagaaggcggaggacgggatcgcggagctcctcctgaatcggccggatgcgatgaacgcgctcaattacgcgctgctccgcgcgctggaagatgccgtgcgcgagatcgcggaggaccgcggcgtgcgtgccgtgatcgtgcgcggggagggaaagggattctgcgcgggagcggatttgaaggaacggcgcggcctggcgcctcacgaagtgcggcgcaacgtgcgcttgacgcgcgaggcgttcgatcgcgtcgcgcgcctgccgcagccgaccatcgcggtcctgcatggattcgcgttcggaggcgggctggagctggcgctggcgtgcgactttcgcatcggcagtcgcgatcttcggctcggtctgacggagacgtcgattgccatcgtccctggggcgggcgggacgcagcggctggcccgcctcatcgggccgacgtgggccaagtggatgatcttcacggccgcgcgcatcgacgcggagcgcgcgagagagctcggcatcctgctcgaggtggcggatacccgagaggccgcgatggacgccgcgcgagcgctggcccgcgccatcgccgaaaacgggccggtcgcggtgcgccaggcgaagtgggccatcgatcgcggcctggacgtcgatctgtcgacggggcttgccatcgaggatgcggcgtatgagggcgttctgccgacctcggatcggctggaggcgctcgcggcgttcgcggaaaagcgcaagccgcacttccgcggtgaatag

SEQ ID NO: 457 - DNA, 783 bp, Artificial
  Substituion in SEQ ID NO 444
gtggaacagccgattgtgtggcagaaggcggaggacgggatcgcggagctcctcctgaatcggccggatgcgatgaacgcgctcaattacgcgctgctccgcgcgctggaagatgccgtgcgcgagatcgcggaggaccgcggcgtgcgtgccgtgatcgtgcgcggggagggaaagggattctgcgcgggagcggatttgaaggaacggcgcggcctggcgcctcacgaagtgcggcgcaacgtgcgcttgacgcgcgaggcgttcgatcgcgtcgcgcgcctgccgcagccgaccatcgcggtcctgcatggattcgcgttcggaggcgggctggagctggcgctggcgtgcgactttcgcatcggcagtcgcgaacttcggctcggtctgacggagacgtcgctcgccatcgtccctggggcgggcgggacgcagcggctggcccgcctcatcgggccgacgtgggccaagtggatgatcttcacggccgcgcgcatcgacgcggagcgcgcgagagagctcggcatcctgctcgaggtggcggatacccgagaggccgcgatggacgccgcgcgagcgctggcccgcgccatcgccgaaaacgggccggtcgcggtgcgccaggcgaagtgggccatcgatcgcggcctggacgtcgatctgtcgacggggcttgccatcgaggatgcggcgtatgagggcgttctgccgacctcggatcggctggaggcgctcgcggcgttcgcggaaaagcgcaagccgcacttccgcggtgaatag

SEQ ID NO: 458 - DNA, 783 bp, Artificial
  Substituion in SEQ ID NO 444
gtggaacagccgattgtgtggcagaaggcggaggacgggatcgcggagctcctcctgaatcggccggatgcgatgaacgcgctcaattacgcgctgctccgcgcgctggaagatgccgtgcgcgagatcgcggaggaccgcggcgtgcgtgccgtgatcgtgcgcggggagggaaagggattctgcgcgggagcggatttgaaggaacggcgcggcctggcgcctcacgaagtgcggcgcaacgtgcgcttgacgcgcgatgcgttcgatcgcgtcgcgcgcctgccgcagccgaccatcgcggtcctgcatggattcgcgttcggaggcgggctggagctggcgctggcgtgcgactttcgcatcggcagtcgcgatcttcggctcggtctgacggagacgtcgctcgccatcgtccctggggcgggcgggacgcagcggctggcccgcctcatcgggccgacgtgggccaagtggatgatcttcacggccgcgcgcatcgacgcggagcgcgcgagagagctcggcatcctgctcgaggtggcggatacccgagaggccgcgatggacgccgcgcgagcgctggcccgcgccatcgccgaaaacgggccggtcgcggtgcgccaggcgaagtgggccatcgatcgcggcctggacgtcgatctgtcgacggggcttgccatcgaggatgcggcgtatgagggcgttctgccgacctcggatcggctggaggcgctcgcggcgttcgcggaaaagcgcaagccgcacttccgcggtgaatag

SEQ ID NO: 459 - DNA, 783 bp, Artificial
  Substituion in SEQ ID NO 444
gtggaacagccgttagtgtggcagaaggcggaggacgggatcgcggagctcctcctgaatcggccggatgcgatgaacgcgctcaattacgcgctgctccgcgcgctggaagatgccgtgcgcgagatcgcggaggaccgcggcgtgcgtgccgtgatcgtgcgcggggagggaaagggattctgcgcgggagcggatttgaaggaacggcgcggcctggcgcctcacgaagtgcggcgcaacgtgcgcttgacgcgcgaggcgttcgatcgcgtcgcgcgcctgccgcagccgaccatcgcggtcctgcatggattcgcgttcggaggcgggctggagctggcgctggcgtgcgactttcgcatcggcagtcgcgatcttcggctcggtctgacggagacgtcgctcgccatcgtccctggggcgggcgggacgcagcggctggcccgcctcatcgggccgacgtgggccaagtggatgatcttcacggccgcgcgcatcgacgcggagcgcgcgagagagctcggcatcctgctcgaggtggcggatacccgagaggccgcgatggacgccgcgcgagcgctggcccgcgccatcgccgaaaacgggccggtcgcggtgcgccaggcgaagtgggccatcgatcgcggcctggacgtcgatctgtcgacggggcttgccatcgaggatgcggcgtatgagggcgttctgccgacctcggatcggctggaggcgctcgcggcgttcgcggaaaagcgcaagccgcacttccgcggtgaatag

SEQ ID NO: 460 - protein, 986 aa, Alicyclobacillus acidocaldarius
MSVDLKRTFTLDGSPLTATEGETILQAMLAAGLDFPHICYHPALGPIETCDTCMVEVNGDLVRACATPVVEGMSVRTKSVAARYARKEAMDRILKNHDLYCTVCDNNNGNCVVHNTTMAMDIDHQSYPFREKPYEVDMSHPFYRYDPSQCILCGRCVEACQNLQVSEVLSIDWDREIPRVIWDNDVPINESSCVSCGHCVTVCPCNALMEKSMLGKAGFLTGIEPEPLQRMIDVTKAVEPGYRAIFAISEIESHMRNSRIKRTKTVCTYCGVGCSFDIWTKDRDILKVEPQMEAPTNQISTCVKGKFGWDFVNSPDRLTKPLIRKGDAFHEVSWDEALDFVAKRLTEIRQQYGDDAIALISSSKCTNEENYLMQKLARAVLHTNNIDNCSRYCQSPATEGLRRTMGYGGDTGSLHDLAMADLLIIIGANPAESHPVFSTRMRRAKKKYGQKHIVIDLREHDMAHRADLFVRPNPGTDLVLISAVTRYIIDQGWHDADFVRDRVDGFEDFVRSLEPYTLEYAERVTGVPRDTVIQIATMIHEAKSTCICWAMGVTQHKGGSETSTAICNLLLVTGNVGRPGTGAYPLRGHNNVQGAGDMGCSPVYMPGYERVDDPAVRAKYETAWVVELPTSKGLDNHEMVDAIHEGKLRALIIQGEEMALVDSNSHYVREAFAKLDLLVVIDVFFSKTAEYADVVLAASPSLEKEGTFTNTERRIQRLYQVFEPLGESRPDWVILRDLANRLGANWTYAHPSEILEEMASLAALMQGVRWDRLEGYRSLQWPVHPDGTDTPLLYTNGFPFPNGKARLVPARWIEPTAFEPEYDLHLNNGRMLEHFHEGNLTYRVHGLKEKVPTTYLEVSPELAKERGIETGALVRLISPYGELKLPVVVTDRVKGKQMYLPMNTSNDEEAINILTSSESDETTHTPAYKELQVRMEVIRPRGESPMTRFNFRMHRPNPQSGVRVERKWSRRGYVPVAEAAKEKARG

SEQ ID NO: 461 - DNA, 2961 bp, Alicyclobacillus acidocaldarius
atgagcgttgatttgaagcgaaccttcacgctggacggatcgcccctgacggcgaccgagggggagaccatcctgcaggcgatgttggcggctggcctagactttccccacatctgttatcatcctgcgcttggccccatcgagacctgcgacacgtgcatggtagaggtgaatggcgatctcgtccgggcgtgcgcgaccccggtcgtcgagggcatgtcggtccgcaccaaatccgtggccgcgcggtacgcgcgcaaggaggcgatggatcgcatcctgaaaaaccacgacctctactgcacggtctgcgacaacaacaacggcaactgcgtggtgcacaacaccacgatggcgatggacatcgaccatcagtcgtacccgttccgcgagaagccgtacgaagtcgacatgtcgcacccgttctaccggtacgatccgagccagtgcatcctctgcgggcgatgcgtcgaggcgtgtcagaacctgcaggtcagtgaagtgctttccatcgactgggatcgcgagattccgcgcgtcatctgggacaatgacgtccccatcaacgagtcgtcgtgcgtctcgtgcggccactgcgtgaccgtctgcccctgcaatgcgctcatggagaagtcgatgctcggcaaggctggattcctcacgggcatcgaaccggagccgctgcagcggatgatcgacgtgacgaaggcggtggagcccggctaccgcgccatctttgccatctccgagatcgagagccacatgcggaattcccgcatcaagcgcacgaagaccgtgtgcacgtactgcggcgtgggctgctcgtttgacatctggacgaaggaccgggacatcctgaaggtcgaaccgcagatggaggcgccgaccaaccagatctccacctgcgtcaagggaaagttcggctgggattttgtgaatagcccggaccgcctcacgaagcccctcatccgcaagggcgacgcgtttcatgaggtgtcgtgggacgaggccttggacttcgtcgcgaagcgcctgacggaaatccgccagcaatacggcgacgatgccatcgcattgatctcgtcctcgaagtgcaccaacgaggaaaactacctgatgcaaaaactcgcccgcgccgttctccacacgaacaacatcgacaactgttcacggtactgccagtcgcccgccaccgagggtctgcgccggaccatgggttacggcggcgacaccggctcgctccacgatctcgccatggccgatctgctcatcatcattggcgcgaacccggccgagtcccaccccgtcttctcgacccgcatgcggcgggccaagaagaagtacggccagaagcacatcgtgatcgaccttcgcgaacacgatatggcgcaccgcgccgacctgttcgtccggccgaatcctggaaccgatctggtgctcatctcggccgtgacgaggtacatcatcgaccagggttggcacgacgccgacttcgtgcgcgatcgcgtcgacggttttgaagatttcgtccgctcgctcgagccgtatacgctcgagtacgccgagcgcgtgacgggcgtgccgcgcgacaccgtgattcagatcgccacgatgatccatgaggccaagtccacctgcatctgttgggcgatgggcgtgacgcagcacaaggggggcagcgagaccagcaccgccatctgcaacctcctgctcgtcacggggaacgtcgggcgcccaggcaccggggcctatccgctccgaggccacaacaacgtccaaggggcgggcgacatgggctgcagcccggtgtacatgccgggctacgagcgcgtcgatgatccggccgtgcgagccaagtacgagacggcctgggtcgtggagctgccgacgagcaaggggctcgacaaccacgagatggtggacgcgattcacgagggcaaacttcgggcccttatcattcagggcgaggagatggcgctcgtcgactcgaattcgcactacgtccgcgaggcgtttgcgaagctggatctgctcgtcgtgatcgacgtgttcttcagcaagactgctgagtacgccgacgtggtgctcgccgcgagcccgagcctggagaaggagggcacgttcacgaacacggaacggcgcatccagcgcctgtaccaggtgttcgaaccgctcggcgaatctcgcccggactgggtcattctgcgcgatctcgccaatcgcctgggcgccaactggacgtacgcgcacccgtccgaaatcctcgaggaaatggcgagcttggcggcgctgatgcagggggttcgctgggatcgactggagggctatcgcagcctgcagtggccggttcatcccgacgggaccgatacgccgctgctctacacgaacggtttcccgttcccgaatgggaaggcgcggctcgttcccgccaggtggatcgaaccgaccgcgtttgaaccggagtatgatctccatctcaacaacggccgcatgctcgagcacttccacgaggggaatctaacctatcgcgtccacggcctcaaggaaaaggtgccgacgacgtacctcgaggtgtcgccagaactcgccaaggagcggggcatcgagacgggggcgttggttcgcctcatctcgccgtacggcgagttgaagcttcccgtcgtggtgacggatcgagtcaagggcaagcaaatgtatttgccgatgaacacgtccaacgatgaagaggccatcaacatcctcacgtcgagcgagtcggacgagacgacgcacacgccggcgtacaaggagctgcaggtgcggatggaagtgattcggccgcgtggggaaagcccgatgacacggttcaacttccggatgcacaggccgaatccgcaatccggcgtgcgcgtcgaacggaagtggtcgcggcgcggttacgtgccggtggccgaggcggcgaaggaaaaggcgagggggtga

SEQ ID NO: 462 - protein, 971 aa, Bacillus amyloliquefaciens FZB42
TINGVEMEAPDGQTVLQLLNNSSIDVPHVCYHPSLGPIETCDTCIVNVNGELVRSCSAQIKDGDVIDTLSSDVKKAQIIGMDNILHNHELYCTVCDYNNGSCEVHNTVKEMKINHQSIPFDQKPYPKDESNPFYRYDPDQCILCGRCVEACQDVQVTETLSIDWERKRPRVIWDQDVPINESSCVSCGHCSTVCPCNAMMEKGMEGEAGYLTGINQETLRPMIDITKGVETGYGSILAISDMESAMRDERIKKTKTVCTYCGVGCSFDIWTKGRDILKVEPQAEAPANGISTCVKGKFGWDFVNSEKRLTKPLIREGDSFREAEWDEALQLIADKFTDIKEHFGPDALAFITSSKCTNEESYVMQKLARAVIGTNNVDNCSRYCQSPATAGLFRTVGYGGDSGSITDIEKAELVLIIGSNTSESHPVLSTRIKRSHKLHGQKLVVADLRKHEMAERSDVFFQPRAGSDIVWLNAVSKYLLDHDLADTSFLKERVNGLDEFVKSLEPYTMEYAEKHTGVDKDTLIKVARMIHEAGSVCALWAMGVTQHIGGSDTSTAISNMLLVTGNYGKPGAGSYPLRGHNNVQGASDFGSMPDSFPGYEKVTDEKARKKYEQGWGTDLPKEIGMTNHEMIEGIHSGKLKSMYLKGEEMGLVDSNINHVHAAFEKLDFFVVQDIFLSRTAEFADVVLPASPSLEKEGTFTNTERRVQRLYEVFEPLGDSKPDWQIITDIANRLGADWHYEHPADIMEEAAMLSPLYAGVTYERLEGYNSLQWPVAADGTDSPLLFTDKFPFSDGKAILYPVQWTEPKEFDEEYDIHVNNGRLLEHFHEGNLTYRSKGISEKTPSVFLEVSPELAEERGLEDGTLVRLTSPYGNVKVKCVITDRVKGKQVYLPMNDSKDAAINLLTSSYADKDTDTPAYKETSAKMEILKKEGVNPLPKINFRYGNPQPQIGVRVDRKWARKDYVFPGDAVK

SEQ ID NO: 463 - protein, 966 aa, Bacillus coagulans 36D1
INGQELAARKGQTILEVANAHDMYIPAICYHPNLGSIQTCDTCFVNVNGNLVRACATKVEPGMEVESGSKPVKDAQYEAMSRILKNHELYCTVCDNNNGNCVVHNTAEHLEIEHQKYQFEAKPYPPDQSHPFYRYEPDQCILCGRCVEACQDLQVNETLTIDWDREVPRVIWDNDVPIDESSCVSCGHCVTVCPCNALMEKSMLGEAGYLTGIPQKVLEPMIDLTKEVEPGYKEIFAISEMEAAMRKSRIKRTKTVCTYCGVGCSFEIWTKGRHILKVEPQEHAPVNGISTCVKGKFGWDFVNSEERLTKPLIRKGEEFVEASWDEALNLIASKLQEIKKQHGPDALGFIASSKCSNEENYLFQKFARAIIGTNNLDNCSRYCQSPATSGLLRTVGIGGDSGTIRDIQQADLVVTVGANPAESHPVLATRIKRAHKLHGQKLMVVDLRENELASRANLFIHSKPSTDLIWLNAVTKYILDQGWEDKAFLEARVKGLDKFRASLEKYTLAFAEEKTGISKENLIKMATMIHEAKSVCILWAMGITQHTCGTDASTAISNLLLVTGNYGRPGTGAYPLRGHNNVQGACDFGTMPAWFPGYEPVEDNEVRERYEKAWGVKLPENPGLDNHQMIGGIKSGKLRGLYLFGEEMAIVDSNINFVEEHLEKLDFFVVQDVFFSKTAQFADVILPAAPSLEKEGTFTNTERRIQRFYQVFEPMGESKPDWVIFQELANKMGAQWHYQHPGEIMAEAASLAKYFAGISYERLEGFNSQIWPVKKDGTSTPLLYQDRFAFPDGKARLVPVDWEPPFSAGEGFDYHLNNGRLLEQFHEGNLTDRSPGIHHKVPEPWLEISPEAASERGIKDGALVRLTSPYGKVKVRAVVTGRVQGKELYLTMNARKEDEMVNRLTSSYHDRVTHTPNYKEMGVKMEILEEKGKPPLPKVNHRYGNRIPQISVRVEEKWKRDDFIPI

SEQ ID NO: 464 - protein, 987 aa, Bacillus sp. NRRL B-14911
DLPDTYQVKLNGAEVKVAAGDETTILQLLQNSSVEVPNVCYHPSLGPIETCDTCIVSVNGELVRSCSTKLNDGDIIDTVSADVKEAQVIGMDRILTNHELYCTVCDYNNGGCEVHNTVKEMKINHQSVPFAQKPYPADNSHPFYRYDPDQCILCGRCVEACQDVQVTETLTIDWEREKPRVIWDNDVPINESSCVSCGHCSTVCPCNAMLEKGMEGEAGYLTGIAKQTLRPMIEITKNVETGYGSILAISDMEAAMRDERIKKTKTVCTYCGVGCSFDVWTKGREILKVDPQPEAPANGISTCVKGKFGWDFVNSEERLTKPLIREGEFFREAEWDEAISLIARRFTEIKNEHGAQAMSFISSSKCTNEESFLMQKLGRAVIGTNNIDNCSRYCQTPATVGLFRTVGYGGDAGSIRDIQMSDLVLIIGSNTAESHPVLSTRVKRSHKLGGQKLIVADLRKHEMADRADLFVQPKAGTDIVWLSAVAKYIIDNGMADEEFLAEKVNGLDEFTKNLEKYTMEYAAEVTGIALEQLIDMAEMIGRAKSVCALWAMGITQHMGGSDASTAISNLLLVTGNYAKPGAGAYPLRGHNNVQGASDFGSMPNMFPGYQEVADPEIRKKYELAWGTELPGEPGLNNHEMVEGIHAGTLKAMYLKGEDMGLVDSNINHVHAAFEKLDFFVVQDIFLSKTAEFADVVLPASPSLEKEGTFTNTERRIQRLYQALEPLGDSKPDWQIIMEIANSLGAGWNYTHPSEIMEEASRLMPLYSGVTYERLEGYNSLQWPVAEDGQDTPLLYTERFPFEDGRARLVPVDWTKPLEFEEEYDLHINNGRLLEHFHEGNMTYRSKGISEKTPSVFLEVSPELAEERGLESGTLVRLSSPYGNVKVQCHITDRVKGKEVYLPMNDRGEAAINLLTSSYADKDTDTPAYKEIRAKMEILKAKGEDPLPRINHRYGNPQPQIGVQVQKKWARKDYIFPGDLVKKEREHG

SEQ ID NO: 465 - protein, 975 aa, Bacillus subtilis subsp. subtilis str. 168
KKTITINGVEMEASEEQTVLQLLNNSSIEVPQVCYHPSLGPIETCDTCIVSINGELKRSCSAELKDGDVIDTLSPDVKKAQVIGMDKILYNHELYCTVCDYNNGGCEIHNTVKEMKINHQSIPFDHKPYHKDESHPFYRYDPDQCILCGRCVEACQDVQVTETLTIDWERKRPRVIWDNDVPINESSCVSCGHCSTVCPCNAMMEKGMEGEAGYLTGINNETLRPMIEITKGVETGYGSILAISDMESAMRDERIKKTKTVCTYCGVGCSFDVWTKGRDILKVEPQEEAPANGISTCVKGKFGWDFVNSEERLTKPLIREGDHFREAEWEEALLLIASKFTELKEAFGPDSLAFITSSKCTNEESYLMQKLARGVIGTNNVDNCSRYCQSPATAGLFRTVGYGGDSGSITDIAQADLVLIIGSNTSESHPVLSTRIKRAHKLRGQKVIVADIRKHEMAERSDLFVQPRAGSDIVWLNAIAKYLIENGKADERFLRERVNGRDEYVKSLAPYTLEYAEEKTGIDQETLIQMAEMIGQADSVCALWAMGVTQHIGGSDTSTAISNLLLVTGNYGKPGAGSYPLRGHNNVQGASDFGSMPDRLPGYEKVTDEQVRQKYERVWGVPLPKEPGMTNHEMIEKIHSGQLKAMYVKGEEMGLVDSNINHVHAAYEKLDFFVVQDIFLSRTAEFADVVLPASPSLEKEGTFTNTERRIQRLYQVFEPLGESKPDWQIIMEVANKLGAGWLYEHPADIMEEAAKLSPIYAGVTYERLEGYNSLQWPVNADGKDSPLLFTERFPFPDGKAILYPVQWTEPKEFGEEYDIHVNNGRLLEHFHEGNLTYKSKGISEKTPEVFLEISPELAAERGIQDGTLVRLTSPFGNVKVKCLITDRVKGKEVYLPMNDSGEAAINLLTGSHADKDTDTPAYKETSAKMEILKHDGISPLPKINHRNGNPQPQIGVQVHKKWARKDYIFPGDAVK

SEQ ID NO: 466 - protein, 980 aa, Bacillus licheniformis ATCC 14580
MEMAEQKKITINGVEMEASEEQTVLQLLNNSSIEVPQICYHPSLGPIETCDTCIVSINGELKRSCSAEVKDGDVIDTLSPDVKKAQVIGMDKILYNHELYCTVCDYNNGGCEIHNTVKEMKVNHQSIPFDQKPYHKDESNPFYRYDPDQCILCGRCVEACQDVQVTETLTIDWERKRPRVIWDNDVPINESSCVSCGHCSTVCPCNAMMEKGMEGEAGYLTGIDDETLRPMIEITKGVETGYGSILAISDMESAMRDERIKKTKTVCTYCGVGCSFDVWTKGRDILKVEPQEEAPANGISTCVKGKFGWDFINSEERLTKPLIREGDHFREAEWEEALTLIASKFTDLKEEFGPDSLAFITSSKCTNEESYLMQKLARGIIGTNNVDNCSRYCQSPATAGLFRTVGYGGDSGSIADIAQADLVLIIGSNTSESHPVLSTRIKRAHKLRGQKVIVADIRKHEMAERSDLFVQPRAGSDIVWLNAIAKYLIENGKADERFLQERVNGRDEYVKSLTPYTLEYAEEKTGIDQETLIQMAEMIGQADSVCALWAMGVTQHIGGSDTSTAISNLLLVTGNYGKPGAGSYPLRGHNNVQGASDFGSMPDRLPGYEKVTDEQVRQKYEQAWGVPLPKEPGMTNHEMIEKIHSGKLKAMYVKGEEMGLVDSNINHVHAAYEKLDFFVVQDIFFSRTAEFADVVLPASPSLEKEGTFTNTERRIQRLYQVFEPLGESKPDWQIIMEVANKLGADWHYEHPADIMEEAAKLSPIYAGVTYERLEGYNSLQWPVSADGKDSPLLFTERFPFPDGKAILYPVHWTEPEEFGEEYDIHVNNGRLLEHFHEGNLTYKSKGISKKTPEVFLEISPELAAERGIQDGTLVRLTSPFGNVKVKCLITDRVKGKEVYLPMNDSGEAAINLLTGSHADKDTDTPAYKETSAKMEILKRDGSNPLPKINHRNGNPQPQIGVQVQKKWARKDYIFPGDAVK

SEQ ID NO: 467 - protein, 986 aa, Artificial
  Substituion in SEQ ID NO 460
MSVDLKRTFTLDGSPLTATEGETILQAMLAAGLDFPHICYHPALGPIETCDTCMVEVNGDLVRACATPVVEGMSVRTKSVAARYARKEAMDRILKNHDLYCTVCDNNNGNCVVHNTTMAMDIDHQSYPFREKPYEVDMSHPFYRYDPSQCILCGRCVEACQNLQVSEVLSIDWDREIPRVIWDNDVPINESSCVSCGHCVTVCPCNALMEKSMLGKAGFLTGIEPEPLQRMIDVTKAVEPGYRAIFAISEIESHMRNSRIKRTKTVCTYCGVGCSFDIWTKDRDILKVEPQMEAPTNQISTCVKGKFGWDFVNSPDRLTKPLIRKGDAFHEVSWDEALDFVAKRLTEIRQQYGEDAIALISSSKCTNEENYLMQKLARAVLHTNNIDNCSRYCQSPATEGLRRTMGYGGDTGSLHDLAMADLLIIIGANPAESHPVFSTRMRRAKKKYGQKHIVIDLREHDMAHRADLFVRPNPGTDLVLISAVTRYIIDQGWHDADFVRDRVDGFEDFVRSLEPYTLEYAERVTGVPRDTVIQIATMIHEAKSTCICWAMGVTQHKGGSETSTAICNLLLVTGNVGRPGTGAYPLRGHNNVQGAGDMGCSPVYMPGYERVDDPAVRAKYETAWVVELPTSKGLDNHEMVDAIHEGKLRALIIQGEEMALVDSNSHYVREAFAKLDLLVVIDVFFSKTAEYADVVLAASPSLEKEGTFTNTERRIQRLYQVFEPLGESRPDWVILRDLANRLGANWTYAHPSEILEEMASLAALMQGVRWDRLEGYRSLQWPVHPDGTDTPLLYTNGFPFPNGKARLVPARWIEPTAFEPEYDLHLNNGRMLEHFHEGNLTYRVHGLKEKVPTTYLEVSPELAKERGIETGALVRLISPYGELKLPVVVTDRVKGKQMYLPMNTSNDEEAINILTSSESDETTHTPAYKELQVRMEVIRPRGESPMTRFNFRMHRPNPQSGVRVERKWSRRGYVPVAEAAKEKARG

SEQ ID NO: 468 - protein, 986 aa, Artificial
  Substituion in SEQ ID NO 460
MSVDLKRTFTLDGSPLTATEGETILQAMLAAGLDFPHICYHPALGPIETCDTCMVEVNGDLVRACATPVVEGMSVRTKSVAARYARKEAMDRILKNHDLYCTVCDNNNGNCVVHNTTMAMDIDHQSYPFREKPYEVDMSHPFYRYDPSQCILCGRCVEACQNLQVSEVLSIDWDREIPRVIWDNDVPINESSCVSCGHCVTVCPCNALMEKSMLGKAGFLTGIEPEPLQRMIDVTKAVEPGYRAIFAISEIESHMRNSRIKRTKTVCTYCGVGCSFDIWTKDRDILKVEPQMEAPTNQISTCVKGKFGWDFVNSPDRLTKPLIRKGDAFHEVSWDEALDFVAKRLTEIRQQYGDDAIALISSSKCTNEENYLMQKLARAVLHTNNIDNCSRYCQSPATEGLRRTMGYGGDTGSLHDLAMADLLIIIGANPAESHPVFSTRMRRAKKKYGQKHIVIDLREHDMAHRADLFVRPNPGTDLVLISAVTRYIIDQGWHDADFVRDRVDGFEDFVRSLEPYTLEYAERVTGVPRDTVIQIATMIHEAKSTCICWAMGVTQHKGGSETSTAICNLLLVTGNVGRPGTGAYPLRGHNNVQGAGDMGCSPVYMPGYERVDDPAVRAKYETAWVVELPTSKGLDNHEMVDAIHEGKLRALIIQGEEMALVDSNSHYVREAFAKLDLLVVIDVFFSKTAEYADVVLAASPSLEKEGTFTNTERRIQRLYQVFEPLGESRPDWVILRDLANRLGANWTYAHPSEILEEMASLAALMQGVRWDRLEGYRSLQWPVHPDGTDTPLLYTNGFPFPNGKARLVPARWIEPTAFEPEYDLHLNNGRMLEHFHEGNLTYRVHGLREKVPTTYLEVSPELAKERGIETGALVRLISPYGELKLPVVVTDRVKGKQMYLPMNTSNDEEAINILTSSESDETTHTPAYKELQVRMEVIRPRGESPMTRFNFRMHRPNPQSGVRVERKWSRRGYVPVAEAAKEKARG

SEQ ID NO: 469 - protein, 986 aa, Artificial
  Substituion in SEQ ID NO 460
MSVDLKRTFTLDGSPLTATEGETILQAMLAAGLDFPHICYHPALGPIETCDTCMVEVNGDLVRACATPVVEGMSVRTKSVAARYARKEAMDRILKNHDLYCTVCDNNNGNCVVHNTTMAMDIDHQSYPFREKPYEVDMSHPFYRYDPSQCILCGRCVEACQNLQVSEVLSIDWDREIPRVIWDNDVPINESSCVSCGHCVTVCPCNALMEKSMLGKAGFLTGIEPEPLQRMIDVTKAVEPGYRAIFAISEIESHMRNSRIKRTKTVCTYCGVGCSFDIWTKDRDILKVEPQMEAPTNQISTCVKGKFGWDFVNSPDRLTKPLIRKGDAFHEVSWDEALDFVAKRLTEIRQQYGDDAIALISSSKCTNEENYLMQKLARAVLHTNNIDNCSRYCQSPATEGLRRTMGYGGDTGSLHDLAMADLLIIIGANPAESHPVFSTRMRRAKKKYGQKHIVIDLREHDMAHRADLFVRPNPGTDLVLISAVTRYIIDQGWHDADFVRDRVDGFEDFVRSLEPYTLEYAERVTGVPRDTVIQIATMIHEAKSTCICWAMGVTQHKGGSETSTAICNLLLVTGNVGRPGTGAYPLRGHNNVQGAGDMGCSPVYMPGYERVDDPAVRAKYETAWVVDLPTSKGLDNHEMVDAIHEGKLRALIIQGEEMALVDSNSHYVREAFAKLDLLVVIDVFFSKTAEYADVVLAASPSLEKEGTFTNTERRIQRLYQVFEPLGESRPDWVILRDLANRLGANWTYAHPSEILEEMASLAALMQGVRWDRLEGYRSLQWPVHPDGTDTPLLYTNGFPFPNGKARLVPARWIEPTAFEPEYDLHLNNGRMLEHFHEGNLTYRVHGLKEKVPTTYLEVSPELAKERGIETGALVRLISPYGELKLPVVVTDRVKGKQMYLPMNTSNDEEAINILTSSESDETTHTPAYKELQVRMEVIRPRGESPMTRFNFRMHRPNPQSGVRVERKWSRRGYVPVAEAAKEKARG

SEQ ID NO: 470 - protein, 986 aa, Artificial
  Substituion in SEQ ID NO 460
MSVDLKRTFTLDGSPLTATEGETILQAMLAAGLDFPHICYHPALGPIETCDTCMVEVNGDLVRACATPVVEGMSVRTKSVAARYARKEAMDRILKNHDLYCTVCDNNNGNCVVHNTTMAMDIDHQSYPFREKPYEVDMSHPFYRYDPSQCILCGRCVEACQNLQVSEVLSIDWDREIPRVIWDNDVPINESSCVSCGHCVTVCPCNALMEKSMLGKAGFLTGIEPEPLQRMIDVTKAVEPGYRAIFAISEIESHMRNSRIKRTKTVCTYCGVGCSFDIWTKDRDILKVEPQMEAPTNQISTCVKGKFGWDFVNSPDRLTKPLIRKGDAFHEVSWDEALDFVAKRLTEIRQQYGDDAIALISSSKCTNEENYLMQKLARAVLHTNNIDNCSRYCQSPATEGLRRTMGYGGDTGSLHDLAMADLLIIIGANPAESHPVFSTRMRRAKKKYGQKHIVIDLREHDMAHRADLFVRPNPGTDLVLISAVTRYIIDQGWHDADFVRDRVDGFEDFVRSLEPYTLEYAERVTGVPRDTVIQIATMIHEAKSTCICWAMGVTQHKGGSETSTAICNLLLVTGNVGRPGTGAYPLRGHNNVQGAGDMGCSPVYMPGYERVDDPAVRAKYETAWVVELPTSKGLDNHEMVDAIHEGKLRALIIQGEEMALVDSNSHYVREAFAKLDLLVVIDVFFSKTAEYADVVLAASPSLEKEGTFTNTERRIQRLYQVFEPLGESRPDWVILRDLANKLGANWTYAHPSEILEEMASLAALMQGVRWDRLEGYRSLQWPVHPDGTDTPLLYTNGFPFPNGKARLVPARWIEPTAFEPEYDLHLNNGRMLEHFHEGNLTYRVHGLKEKVPTTYLEVSPELAKERGIETGALVRLISPYGELKLPVVVTDRVKGKQMYLPMNTSNDEEAINILTSSESDETTHTPAYKELQVRMEVIRPRGESPMTRFNFRMHRPNPQSGVRVERKWSRRGYVPVAEAAKEKARG

SEQ ID NO: 471 - protein, 986 aa, Artificial
  Substituion in SEQ ID NO 460
MSVDLKRTFTLDGSPLTATEGETILQAMLAAGLDFPHICYHPALGPIETCDTCMVEVNGDLVRACATPVVEGMSVRTKSVAARYARKEAMDRILKNHDLYCTVCDNNNGNCVVHNTTMAMDIDHQSYPFREKPYEVDMSHPFYRYDPSQCILCGRCVEACQNLQVSEVLSIDWDREIPRVIWDNDVPINESSCVSCGHCVTVCPCNALMEKSMLGKAGFLTGIEPEPLQRMIDVTKAVEPGYRAIFAISEIESHMRNSRIKRTKTVCTYCGVGCSFDIWTKDRDILKVEPQMEAPTNQISTCVKGKFGWDFVNSPDRLTKPLIRKGDAFHEVSWDEALDFVAKRLTEIRQQYGDDAIALISSSKCTNEENYLMQKLARAVLHTNNIDNCSRYCQSPATEGLRRTMGYGGDTGSLHDLAMADLLIIIGANPAESHPVFSTRMRRAKKKYGQKHIVIDLREHDMAHRADLFVRPNPGTDLVLISAVTRYIIDQGWHDADFVRDRVDGFEDFVRSLEPYTLEYAERVTGVPRDTVIQIATMIHEAKSTCICWAMGVTQHKGGSETSTAICNLLLVTGNVGRPGTGAYPLRGHNNVQGAGDMGCSPVYMPGYERVDDPAVRAKYETAWVVELPTSKGLDNHEMVDAIHEGKLRALIIQGEEMALVDSNSHYVREAFAKLDLLVVIDVFFSKTAEYADVVLAASPSLEKEGTFTNTERRIQRLYQVFEPLGESRPDWVILRDLANRLGANWTYAHPSEILEEMASLAALMQGVRWDRLEGYRSLQWPVHPDGTDTPLLYTNGFPFPNGKARLVPARWIEPTAFEPEYDLHLNNGRMLEHFHEGNLTYRVHGLKEKVPTTYLEVSPELAKERGIETGALVRLISPYGELKLPVVVTDRVKGKQMYLPMNTSNDEEAINILTSSESDETTHTPAYKELQVRMEVIRPRGESPMTRFNFRMHRPNPQSGVRVERKWSRRGYVPVAEAAKEKAKG

SEQ ID NO: 472 - DNA, 2961 bp, Artificial
  Substituion in SEQ ID NO 461
atgagcgttgatttgaagcgaaccttcacgctggacggatcgcccctgacggcgaccgagggggagaccatcctgcaggcgatgttggcggctggcctagactttccccacatctgttatcatcctgcgcttggccccatcgagacctgcgacacgtgcatggtagaggtgaatggcgatctcgtccgggcgtgcgcgaccccggtcgtcgagggcatgtcggtccgcaccaaatccgtggccgcgcggtacgcgcgcaaggaggcgatggatcgcatcctgaaaaaccacgacctctactgcacggtctgcgacaacaacaacggcaactgcgtggtgcacaacaccacgatggcgatggacatcgaccatcagtcgtacccgttccgcgagaagccgtacgaagtcgacatgtcgcacccgttctaccggtacgatccgagccagtgcatcctctgcgggcgatgcgtcgaggcgtgtcagaacctgcaggtcagtgaagtgctttccatcgactgggatcgcgagattccgcgcgtcatctgggacaatgacgtccccatcaacgagtcgtcgtgcgtctcgtgcggccactgcgtgaccgtctgcccctgcaatgcgctcatggagaagtcgatgctcggcaaggctggattcctcacgggcatcgaaccggagccgctgcagcggatgatcgacgtgacgaaggcggtggagcccggctaccgcgccatctttgccatctccgagatcgagagccacatgcggaattcccgcatcaagcgcacgaagaccgtgtgcacgtactgcggcgtgggctgctcgtttgacatctggacgaaggaccgggacatcctgaaggtcgaaccgcagatggaggcgccgaccaaccagatctccacctgcgtcaagggaaagttcggctgggattttgtgaatagcccggaccgcctcacgaagcccctcatccgcaagggcgacgcgtttcatgaggtgtcgtgggacgaggccttggacttcgtcgcgaagcgcctgacggaaatccgccagcaatacggcgaagatgccatcgcattgatctcgtcctcgaagtgcaccaacgaggaaaactacctgatgcaaaaactcgcccgcgccgttctccacacgaacaacatcgacaactgttcacggtactgccagtcgcccgccaccgagggtctgcgccggaccatgggttacggcggcgacaccggctcgctccacgatctcgccatggccgatctgctcatcatcattggcgcgaacccggccgagtcccaccccgtcttctcgacccgcatgcggcgggccaagaagaagtacggccagaagcacatcgtgatcgaccttcgcgaacacgatatggcgcaccgcgccgacctgttcgtccggccgaatcctggaaccgatctggtgctcatctcggccgtgacgaggtacatcatcgaccagggttggcacgacgccgacttcgtgcgcgatcgcgtcgacggttttgaagatttcgtccgctcgctcgagccgtatacgctcgagtacgccgagcgcgtgacgggcgtgccgcgcgacaccgtgattcagatcgccacgatgatccatgaggccaagtccacctgcatctgttgggcgatgggcgtgacgcagcacaaggggggcagcgagaccagcaccgccatctgcaacctcctgctcgtcacggggaacgtcgggcgcccaggcaccggggcctatccgctccgaggccacaacaacgtccaaggggcgggcgacatgggctgcagcccggtgtacatgccgggctacgagcgcgtcgatgatccggccgtgcgagccaagtacgagacggcctgggtcgtggagctgccgacgagcaaggggctcgacaaccacgagatggtggacgcgattcacgagggcaaacttcgggcccttatcattcagggcgaggagatggcgctcgtcgactcgaattcgcactacgtccgcgaggcgtttgcgaagctggatctgctcgtcgtgatcgacgtgttcttcagcaagactgctgagtacgccgacgtggtgctcgccgcgagcccgagcctggagaaggagggcacgttcacgaacacggaacggcgcatccagcgcctgtaccaggtgttcgaaccgctcggcgaatctcgcccggactgggtcattctgcgcgatctcgccaatcgcctgggcgccaactggacgtacgcgcacccgtccgaaatcctcgaggaaatggcgagcttggcggcgctgatgcagggggttcgctgggatcgactggagggctatcgcagcctgcagtggccggttcatcccgacgggaccgatacgccgctgctctacacgaacggtttcccgttcccgaatgggaaggcgcggctcgttcccgccaggtggatcgaaccgaccgcgtttgaaccggagtatgatctccatctcaacaacggccgcatgctcgagcacttccacgaggggaatctaacctatcgcgtccacggcctcaaggaaaaggtgccgacgacgtacctcgaggtgtcgccagaactcgccaaggagcggggcatcgagacgggggcgttggttcgcctcatctcgccgtacggcgagttgaagcttcccgtcgtggtgacggatcgagtcaagggcaagcaaatgtatttgccgatgaacacgtccaacgatgaagaggccatcaacatcctcacgtcgagcgagtcggacgagacgacgcacacgccggcgtacaaggagctgcaggtgcggatggaagtgattcggccgcgtggggaaagcccgatgacacggttcaacttccggatgcacaggccgaatccgcaatccggcgtgcgcgtcgaacggaagtggtcgcggcgcggttacgtgccggtggccgaggcggcgaaggaaaaggcgagggggtga

SEQ ID NO: 473 - DNA, 2961 bp, Artificial
  Substituion in SEQ ID NO 461
atgagcgttgatttgaagcgaaccttcacgctggacggatcgcccctgacggcgaccgagggggagaccatcctgcaggcgatgttggcggctggcctagactttccccacatctgttatcatcctgcgcttggccccatcgagacctgcgacacgtgcatggtagaggtgaatggcgatctcgtccgggcgtgcgcgaccccggtcgtcgagggcatgtcggtccgcaccaaatccgtggccgcgcggtacgcgcgcaaggaggcgatggatcgcatcctgaaaaaccacgacctctactgcacggtctgcgacaacaacaacggcaactgcgtggtgcacaacaccacgatggcgatggacatcgaccatcagtcgtacccgttccgcgagaagccgtacgaagtcgacatgtcgcacccgttctaccggtacgatccgagccagtgcatcctctgcgggcgatgcgtcgaggcgtgtcagaacctgcaggtcagtgaagtgctttccatcgactgggatcgcgagattccgcgcgtcatctgggacaatgacgtccccatcaacgagtcgtcgtgcgtctcgtgcggccactgcgtgaccgtctgcccctgcaatgcgctcatggagaagtcgatgctcggcaaggctggattcctcacgggcatcgaaccggagccgctgcagcggatgatcgacgtgacgaaggcggtggagcccggctaccgcgccatctttgccatctccgagatcgagagccacatgcggaattcccgcatcaagcgcacgaagaccgtgtgcacgtactgcggcgtgggctgctcgtttgacatctggacgaaggaccgggacatcctgaaggtcgaaccgcagatggaggcgccgaccaaccagatctccacctgcgtcaagggaaagttcggctgggattttgtgaatagcccggaccgcctcacgaagcccctcatccgcaagggcgacgcgtttcatgaggtgtcgtgggacgaggccttggacttcgtcgcgaagcgcctgacggaaatccgccagcaatacggcgacgatgccatcgcattgatctcgtcctcgaagtgcaccaacgaggaaaactacctgatgcaaaaactcgcccgcgccgttctccacacgaacaacatcgacaactgttcacggtactgccagtcgcccgccaccgagggtctgcgccggaccatgggttacggcggcgacaccggctcgctccacgatctcgccatggccgatctgctcatcatcattggcgcgaacccggccgagtcccaccccgtcttctcgacccgcatgcggcgggccaagaagaagtacggccagaagcacatcgtgatcgaccttcgcgaacacgatatggcgcaccgcgccgacctgttcgtccggccgaatcctggaaccgatctggtgctcatctcggccgtgacgaggtacatcatcgaccagggttggcacgacgccgacttcgtgcgcgatcgcgtcgacggttttgaagatttcgtccgctcgctcgagccgtatacgctcgagtacgccgagcgcgtgacgggcgtgccgcgcgacaccgtgattcagatcgccacgatgatccatgaggccaagtccacctgcatctgttgggcgatgggcgtgacgcagcacaaggggggcagcgagaccagcaccgccatctgcaacctcctgctcgtcacggggaacgtcgggcgcccaggcaccggggcctatccgctccgaggccacaacaacgtccaaggggcgggcgacatgggctgcagcccggtgtacatgccgggctacgagcgcgtcgatgatccggccgtgcgagccaagtacgagacggcctgggtcgtggagctgccgacgagcaaggggctcgacaaccacgagatggtggacgcgattcacgagggcaaacttcgggcccttatcattcagggcgaggagatggcgctcgtcgactcgaattcgcactacgtccgcgaggcgtttgcgaagctggatctgctcgtcgtgatcgacgtgttcttcagcaagactgctgagtacgccgacgtggtgctcgccgcgagcccgagcctggagaaggagggcacgttcacgaacacggaacggcgcatccagcgcctgtaccaggtgttcgaaccgctcggcgaatctcgcccggactgggtcattctgcgcgatctcgccaatcgcctgggcgccaactggacgtacgcgcacccgtccgaaatcctcgaggaaatggcgagcttggcggcgctgatgcagggggttcgctgggatcgactggagggctatcgcagcctgcagtggccggttcatcccgacgggaccgatacgccgctgctctacacgaacggtttcccgttcccgaatgggaaggcgcggctcgttcccgccaggtggatcgaaccgaccgcgtttgaaccggagtatgatctccatctcaacaacggccgcatgctcgagcacttccacgaggggaatctaacctatcgcgtccacggcctccgtgaaaaggtgccgacgacgtacctcgaggtgtcgccagaactcgccaaggagcggggcatcgagacgggggcgttggttcgcctcatctcgccgtacggcgagttgaagcttcccgtcgtggtgacggatcgagtcaagggcaagcaaatgtatttgccgatgaacacgtccaacgatgaagaggccatcaacatcctcacgtcgagcgagtcggacgagacgacgcacacgccggcgtacaaggagctgcaggtgcggatggaagtgattcggccgcgtggggaaagcccgatgacacggttcaacttccggatgcacaggccgaatccgcaatccggcgtgcgcgtcgaacggaagtggtcgcggcgcggttacgtgccggtggccgaggcggcgaaggaaaaggcgagggggtga

SEQ ID NO: 474 - DNA, 2961 bp, Artificial
  Substituion in SEQ ID NO 461
atgagcgttgatttgaagcgaaccttcacgctggacggatcgcccctgacggcgaccgagggggagaccatcctgcaggcgatgttggcggctggcctagactttccccacatctgttatcatcctgcgcttggccccatcgagacctgcgacacgtgcatggtagaggtgaatggcgatctcgtccgggcgtgcgcgaccccggtcgtcgagggcatgtcggtccgcaccaaatccgtggccgcgcggtacgcgcgcaaggaggcgatggatcgcatcctgaaaaaccacgacctctactgcacggtctgcgacaacaacaacggcaactgcgtggtgcacaacaccacgatggcgatggacatcgaccatcagtcgtacccgttccgcgagaagccgtacgaagtcgacatgtcgcacccgttctaccggtacgatccgagccagtgcatcctctgcgggcgatgcgtcgaggcgtgtcagaacctgcaggtcagtgaagtgctttccatcgactgggatcgcgagattccgcgcgtcatctgggacaatgacgtccccatcaacgagtcgtcgtgcgtctcgtgcggccactgcgtgaccgtctgcccctgcaatgcgctcatggagaagtcgatgctcggcaaggctggattcctcacgggcatcgaaccggagccgctgcagcggatgatcgacgtgacgaaggcggtggagcccggctaccgcgccatctttgccatctccgagatcgagagccacatgcggaattcccgcatcaagcgcacgaagaccgtgtgcacgtactgcggcgtgggctgctcgtttgacatctggacgaaggaccgggacatcctgaaggtcgaaccgcagatggaggcgccgaccaaccagatctccacctgcgtcaagggaaagttcggctgggattttgtgaatagcccggaccgcctcacgaagcccctcatccgcaagggcgacgcgtttcatgaggtgtcgtgggacgaggccttggacttcgtcgcgaagcgcctgacggaaatccgccagcaatacggcgacgatgccatcgcattgatctcgtcctcgaagtgcaccaacgaggaaaactacctgatgcaaaaactcgcccgcgccgttctccacacgaacaacatcgacaactgttcacggtactgccagtcgcccgccaccgagggtctgcgccggaccatgggttacggcggcgacaccggctcgctccacgatctcgccatggccgatctgctcatcatcattggcgcgaacccggccgagtcccaccccgtcttctcgacccgcatgcggcgggccaagaagaagtacggccagaagcacatcgtgatcgaccttcgcgaacacgatatggcgcaccgcgccgacctgttcgtccggccgaatcctggaaccgatctggtgctcatctcggccgtgacgaggtacatcatcgaccagggttggcacgacgccgacttcgtgcgcgatcgcgtcgacggttttgaagatttcgtccgctcgctcgagccgtatacgctcgagtacgccgagcgcgtgacgggcgtgccgcgcgacaccgtgattcagatcgccacgatgatccatgaggccaagtccacctgcatctgttgggcgatgggcgtgacgcagcacaaggggggcagcgagaccagcaccgccatctgcaacctcctgctcgtcacggggaacgtcgggcgcccaggcaccggggcctatccgctccgaggccacaacaacgtccaaggggcgggcgacatgggctgcagcccggtgtacatgccgggctacgagcgcgtcgatgatccggccgtgcgagccaagtacgagacggcctgggtcgtggatctgccgacgagcaaggggctcgacaaccacgagatggtggacgcgattcacgagggcaaacttcgggcccttatcattcagggcgaggagatggcgctcgtcgactcgaattcgcactacgtccgcgaggcgtttgcgaagctggatctgctcgtcgtgatcgacgtgttcttcagcaagactgctgagtacgccgacgtggtgctcgccgcgagcccgagcctggagaaggagggcacgttcacgaacacggaacggcgcatccagcgcctgtaccaggtgttcgaaccgctcggcgaatctcgcccggactgggtcattctgcgcgatctcgccaatcgcctgggcgccaactggacgtacgcgcacccgtccgaaatcctcgaggaaatggcgagcttggcggcgctgatgcagggggttcgctgggatcgactggagggctatcgcagcctgcagtggccggttcatcccgacgggaccgatacgccgctgctctacacgaacggtttcccgttcccgaatgggaaggcgcggctcgttcccgccaggtggatcgaaccgaccgcgtttgaaccggagtatgatctccatctcaacaacggccgcatgctcgagcacttccacgaggggaatctaacctatcgcgtccacggcctcaaggaaaaggtgccgacgacgtacctcgaggtgtcgccagaactcgccaaggagcggggcatcgagacgggggcgttggttcgcctcatctcgccgtacggcgagttgaagcttcccgtcgtggtgacggatcgagtcaagggcaagcaaatgtatttgccgatgaacacgtccaacgatgaagaggccatcaacatcctcacgtcgagcgagtcggacgagacgacgcacacgccggcgtacaaggagctgcaggtgcggatggaagtgattcggccgcgtggggaaagcccgatgacacggttcaacttccggatgcacaggccgaatccgcaatccggcgtgcgcgtcgaacggaagtggtcgcggcgcggttacgtgccggtggccgaggcggcgaaggaaaaggcgagggggtga

SEQ ID NO: 475 - DNA, 2961 bp, Artificial
  Substituion in SEQ ID NO 461
atgagcgttgatttgaagcgaaccttcacgctggacggatcgcccctgacggcgaccgagggggagaccatcctgcaggcgatgttggcggctggcctagactttccccacatctgttatcatcctgcgcttggccccatcgagacctgcgacacgtgcatggtagaggtgaatggcgatctcgtccgggcgtgcgcgaccccggtcgtcgagggcatgtcggtccgcaccaaatccgtggccgcgcggtacgcgcgcaaggaggcgatggatcgcatcctgaaaaaccacgacctctactgcacggtctgcgacaacaacaacggcaactgcgtggtgcacaacaccacgatggcgatggacatcgaccatcagtcgtacccgttccgcgagaagccgtacgaagtcgacatgtcgcacccgttctaccggtacgatccgagccagtgcatcctctgcgggcgatgcgtcgaggcgtgtcagaacctgcaggtcagtgaagtgctttccatcgactgggatcgcgagattccgcgcgtcatctgggacaatgacgtccccatcaacgagtcgtcgtgcgtctcgtgcggccactgcgtgaccgtctgcccctgcaatgcgctcatggagaagtcgatgctcggcaaggctggattcctcacgggcatcgaaccggagccgctgcagcggatgatcgacgtgacgaaggcggtggagcccggctaccgcgccatctttgccatctccgagatcgagagccacatgcggaattcccgcatcaagcgcacgaagaccgtgtgcacgtactgcggcgtgggctgctcgtttgacatctggacgaaggaccgggacatcctgaaggtcgaaccgcagatggaggcgccgaccaaccagatctccacctgcgtcaagggaaagttcggctgggattttgtgaatagcccggaccgcctcacgaagcccctcatccgcaagggcgacgcgtttcatgaggtgtcgtgggacgaggccttggacttcgtcgcgaagcgcctgacggaaatccgccagcaatacggcgacgatgccatcgcattgatctcgtcctcgaagtgcaccaacgaggaaaactacctgatgcaaaaactcgcccgcgccgttctccacacgaacaacatcgacaactgttcacggtactgccagtcgcccgccaccgagggtctgcgccggaccatgggttacggcggcgacaccggctcgctccacgatctcgccatggccgatctgctcatcatcattggcgcgaacccggccgagtcccaccccgtcttctcgacccgcatgcggcgggccaagaagaagtacggccagaagcacatcgtgatcgaccttcgcgaacacgatatggcgcaccgcgccgacctgttcgtccggccgaatcctggaaccgatctggtgctcatctcggccgtgacgaggtacatcatcgaccagggttggcacgacgccgacttcgtgcgcgatcgcgtcgacggttttgaagatttcgtccgctcgctcgagccgtatacgctcgagtacgccgagcgcgtgacgggcgtgccgcgcgacaccgtgattcagatcgccacgatgatccatgaggccaagtccacctgcatctgttgggcgatgggcgtgacgcagcacaaggggggcagcgagaccagcaccgccatctgcaacctcctgctcgtcacggggaacgtcgggcgcccaggcaccggggcctatccgctccgaggccacaacaacgtccaaggggcgggcgacatgggctgcagcccggtgtacatgccgggctacgagcgcgtcgatgatccggccgtgcgagccaagtacgagacggcctgggtcgtggagctgccgacgagcaaggggctcgacaaccacgagatggtggacgcgattcacgagggcaaacttcgggcccttatcattcagggcgaggagatggcgctcgtcgactcgaattcgcactacgtccgcgaggcgtttgcgaagctggatctgctcgtcgtgatcgacgtgttcttcagcaagactgctgagtacgccgacgtggtgctcgccgcgagcccgagcctggagaaggagggcacgttcacgaacacggaacggcgcatccagcgcctgtaccaggtgttcgaaccgctcggcgaatctcgcccggactgggtcattctgcgcgatctcgccaataaactgggcgccaactggacgtacgcgcacccgtccgaaatcctcgaggaaatggcgagcttggcggcgctgatgcagggggttcgctgggatcgactggagggctatcgcagcctgcagtggccggttcatcccgacgggaccgatacgccgctgctctacacgaacggtttcccgttcccgaatgggaaggcgcggctcgttcccgccaggtggatcgaaccgaccgcgtttgaaccggagtatgatctccatctcaacaacggccgcatgctcgagcacttccacgaggggaatctaacctatcgcgtccacggcctcaaggaaaaggtgccgacgacgtacctcgaggtgtcgccagaactcgccaaggagcggggcatcgagacgggggcgttggttcgcctcatctcgccgtacggcgagttgaagcttcccgtcgtggtgacggatcgagtcaagggcaagcaaatgtatttgccgatgaacacgtccaacgatgaagaggccatcaacatcctcacgtcgagcgagtcggacgagacgacgcacacgccggcgtacaaggagctgcaggtgcggatggaagtgattcggccgcgtggggaaagcccgatgacacggttcaacttccggatgcacaggccgaatccgcaatccggcgtgcgcgtcgaacggaagtggtcgcggcgcggttacgtgccggtggccgaggcggcgaaggaaaaggcgagggggtga

SEQ ID NO: 476 - DNA, 2961 bp, Artificial
  Substituion in SEQ ID NO 461
atgagcgttgatttgaagcgaaccttcacgctggacggatcgcccctgacggcgaccgagggggagaccatcctgcaggcgatgttggcggctggcctagactttccccacatctgttatcatcctgcgcttggccccatcgagacctgcgacacgtgcatggtagaggtgaatggcgatctcgtccgggcgtgcgcgaccccggtcgtcgagggcatgtcggtccgcaccaaatccgtggccgcgcggtacgcgcgcaaggaggcgatggatcgcatcctgaaaaaccacgacctctactgcacggtctgcgacaacaacaacggcaactgcgtggtgcacaacaccacgatggcgatggacatcgaccatcagtcgtacccgttccgcgagaagccgtacgaagtcgacatgtcgcacccgttctaccggtacgatccgagccagtgcatcctctgcgggcgatgcgtcgaggcgtgtcagaacctgcaggtcagtgaagtgctttccatcgactgggatcgcgagattccgcgcgtcatctgggacaatgacgtccccatcaacgagtcgtcgtgcgtctcgtgcggccactgcgtgaccgtctgcccctgcaatgcgctcatggagaagtcgatgctcggcaaggctggattcctcacgggcatcgaaccggagccgctgcagcggatgatcgacgtgacgaaggcggtggagcccggctaccgcgccatctttgccatctccgagatcgagagccacatgcggaattcccgcatcaagcgcacgaagaccgtgtgcacgtactgcggcgtgggctgctcgtttgacatctggacgaaggaccgggacatcctgaaggtcgaaccgcagatggaggcgccgaccaaccagatctccacctgcgtcaagggaaagttcggctgggattttgtgaatagcccggaccgcctcacgaagcccctcatccgcaagggcgacgcgtttcatgaggtgtcgtgggacgaggccttggacttcgtcgcgaagcgcctgacggaaatccgccagcaatacggcgacgatgccatcgcattgatctcgtcctcgaagtgcaccaacgaggaaaactacctgatgcaaaaactcgcccgcgccgttctccacacgaacaacatcgacaactgttcacggtactgccagtcgcccgccaccgagggtctgcgccggaccatgggttacggcggcgacaccggctcgctccacgatctcgccatggccgatctgctcatcatcattggcgcgaacccggccgagtcccaccccgtcttctcgacccgcatgcggcgggccaagaagaagtacggccagaagcacatcgtgatcgaccttcgcgaacacgatatggcgcaccgcgccgacctgttcgtccggccgaatcctggaaccgatctggtgctcatctcggccgtgacgaggtacatcatcgaccagggttggcacgacgccgacttcgtgcgcgatcgcgtcgacggttttgaagatttcgtccgctcgctcgagccgtatacgctcgagtacgccgagcgcgtgacgggcgtgccgcgcgacaccgtgattcagatcgccacgatgatccatgaggccaagtccacctgcatctgttgggcgatgggcgtgacgcagcacaaggggggcagcgagaccagcaccgccatctgcaacctcctgctcgtcacggggaacgtcgggcgcccaggcaccggggcctatccgctccgaggccacaacaacgtccaaggggcgggcgacatgggctgcagcccggtgtacatgccgggctacgagcgcgtcgatgatccggccgtgcgagccaagtacgagacggcctgggtcgtggagctgccgacgagcaaggggctcgacaaccacgagatggtggacgcgattcacgagggcaaacttcgggcccttatcattcagggcgaggagatggcgctcgtcgactcgaattcgcactacgtccgcgaggcgtttgcgaagctggatctgctcgtcgtgatcgacgtgttcttcagcaagactgctgagtacgccgacgtggtgctcgccgcgagcccgagcctggagaaggagggcacgttcacgaacacggaacggcgcatccagcgcctgtaccaggtgttcgaaccgctcggcgaatctcgcccggactgggtcattctgcgcgatctcgccaatcgcctgggcgccaactggacgtacgcgcacccgtccgaaatcctcgaggaaatggcgagcttggcggcgctgatgcagggggttcgctgggatcgactggagggctatcgcagcctgcagtggccggttcatcccgacgggaccgatacgccgctgctctacacgaacggtttcccgttcccgaatgggaaggcgcggctcgttcccgccaggtggatcgaaccgaccgcgtttgaaccggagtatgatctccatctcaacaacggccgcatgctcgagcacttccacgaggggaatctaacctatcgcgtccacggcctcaaggaaaaggtgccgacgacgtacctcgaggtgtcgccagaactcgccaaggagcggggcatcgagacgggggcgttggttcgcctcatctcgccgtacggcgagttgaagcttcccgtcgtggtgacggatcgagtcaagggcaagcaaatgtatttgccgatgaacacgtccaacgatgaagaggccatcaacatcctcacgtcgagcgagtcggacgagacgacgcacacgccggcgtacaaggagctgcaggtgcggatggaagtgattcggccgcgtggggaaagcccgatgacacggttcaacttccggatgcacaggccgaatccgcaatccggcgtgcgcgtcgaacggaagtggtcgcggcgcggttacgtgccggtggccgaggcggcgaaggaaaaggcgaaagggtga

SEQ ID NO: 477 - protein, 280 aa, Alicyclobacillus acidocaldarius
MNGVSRFGGAETRRRFVLRYRSGEYRQEEDVIATEFALTLFVNGEEFSTLVCTPTYAEDLVYGFLASEGVIRDVDDVESIRVSLWTGTARVQTKSGAVLSPALYNKRYIGSCCGKGRQSFYFQSDALTARPVEDPVSLSADDVFRAMDLLDASSGLFEETGGVHVAALVREGQLVLARADIGRHNALDKIYGHCLRAGERLSGTAVAFSGRISSEVLLKVAKIGVGVVIARGAPTLLAVDLAEELNITAIGFVRGRAFNVYSHPWRLADAKKAQGAIEGA

SEQ ID NO: 478 - DNA, 843 bp, Alicyclobacillus acidocaldarius
gtgaatggcgtgtcgcgctttgggggagcggaaacgcggaggcgcttcgtgctccgatatcggtccggggagtatcggcaggaggaggacgtgatcgcgacggaattcgcactcacgctgttcgtcaacggcgaggagttctcgacgctcgtgtgcacgccgacctacgcggaggacctggtgtatggctttctcgcttcggaaggcgtcatccgcgacgtggacgacgtcgagtcgattcgggtgagcctgtggacgggaacggcccgtgtacagacgaagtccggcgcggtgctttccccggcgctttacaacaaacggtacatcgggtcttgttgcgggaaggggcgacagagcttctatttccagagcgacgccctgaccgcgcgacccgtcgaggatccggtgtcgctctcggcggacgacgtgtttcgggcgatggatctcctcgacgcgtcgtccgggctgttcgaggaaacgggcggtgtgcacgtggcggcgctggtgcgtgaaggacagctcgtcttggcgagggccgacattggccgccacaacgcgctcgacaagatctacggccactgcctccgggccggcgagaggttgtccggcaccgccgtggcgttcagcggccggatctcgtccgaggtgttgctcaaggtcgccaagatcggtgtgggcgtcgtgatcgcccgaggagctccgacgctgctcgccgtcgatctcgccgaggaactgaacatcacggccatcggttttgtgcgcggccgggccttcaacgtgtacagtcatccgtggcgcttggcggacgccaagaaggcgcagggcgccatcgaaggggcatga

SEQ ID NO: 479 - protein, 258 aa, Geobacillus kaustophilus HTA426
GFAAKRRPIAKYRNGRFVEEEDEIALEFPLTITVNGEEFATIVCTPAHLDELVIGFLASEGAIRTCSDIKGMTIDGERGFAYVELAAGGLPAKQFYAKRFIGSCCGKSRQFYFYNDMKTAKTIVGGITVKADDCIRLMKALHERSTDFAATGGLHNAALATPDEMVVIRSDIGRHNALDKLYGYCLRHQVAMKDKLIVFSGRVSSEVLLKAAKMGVSVLLSKSAPTTLALDLADELGITVVGFLRGQAFNVYTHESRI

SEQ ID NO: 480 - protein, 258 aa, Geobacillus thermodenitrificans NG80-2
GFVAKRRYIVKYRNGQLAEKEDEIALEFPLTVVVNGQEFATIVCTPGHIDELVIGFLASEGVIRVIDDIKAMTIDGERGFVYVELTSDELPAKQFYAKRFIGSCCGKSRQFYFYNDAKTAKTIVGGITVKADDCVCLMKTLHEQSIDFAATGGLHNAALATPDRIVVIRSDIGRHNALDKLYGYCLRHQVAMKDKLIVFSGRVSSEVLLKAAKMGISILLSKSAPTTLALDLAEELGITVVGFLRGQDFNVYTHEKRI

SEQ ID NO: 481 - protein, 252 aa, Bacillus cereus ATCC 14579
IVRYQSGTFSKQLDEIVTESPITIKLNGEEYVTVVCTPNYIEDMVIGFLISEGIISSYNDVEELWVQKDNGIVHVKSSKVNPLYQTLYNKRYVTSCCGKGRQGFIFVNDAAKAKDLHDIHVKITPEECFYLMNTLQQSSTTFRQTGGVHNTALCDRNKILLSRMDIGRHNALDKIYGHCLRNDISVKGKIIAFSGRISSEILLKVSKIGCEIVLSKSAPTKLALQLAHDLGITVVGFIRNESCNIYTHPHRI

SEQ ID NO: 482 - protein, 252 aa, Bacillus thuringiensis serovar israelensis ATCC 35646
IVRYQSGTFSKQLDEIVTESPITIKLNGEEYVTVVCTPNYIEDMVIGFLISEGIISSYKDVEELWVQKDNGIVHVKSSKVNPLYQTLYNKRYITSCCGKGRQGFIFVNDAAKAKDLHDIHVKITPEECFHLMNTLQQSSTTFRQTGGVHNTALCDRNNILLSRMDIGRHNALDKIYGHCLRNDISIKGKIIAFSGRISSEILLKVSKIGCEIVLSKSAPTKLALQLAHDLGITVVGFIRNESCNIYTHPKRI

SEQ ID NO: 483 - protein, 257 aa, Bacillus subtilis subsp. subtilis str. 168
TAVRDVWRYEQGEISKVEDRMVTEFPLTVILNGSEFVTLVCTPEHIEELVIGFLASEGVIRFQKEIKRFTIDESLGFVYVDLVHPETLDQKDYTKRVIGSCCGKGRHFYFQQDVKTAKTAVSQIKISPEACLALMKDMQQGSGTFQDTGGVHNAALCDTEKLLLMRTDIGRHNALDKLYGHCLLNGMSVRDKLIVFSGRISSEVLLKAAKIGVSIVISKSAPTELAIQMAEELNITAIGFVRNGSFNVYTHPERIRE

SEQ ID NO: 484 - protein, 280 aa, Artificial
  Substituion in SEQ ID NO 477
MNGVSRFGGAETRRRFVLRYRSGEYKQEEDVIATEFALTLFVNGEEFSTLVCTPTYAEDLVYGFLASEGVIRDVDDVESIRVSLWTGTARVQTKSGAVLSPALYNKRYIGSCCGKGRQSFYFQSDALTARPVEDPVSLSADDVFRAMDLLDASSGLFEETGGVHVAALVREGQLVLARADIGRHNALDKIYGHCLRAGERLSGTAVAFSGRISSEVLLKVAKIGVGVVIARGAPTLLAVDLAEELNITAIGFVRGRAFNVYSHPWRLADAKKAQGAIEGA

SEQ ID NO: 485 - protein, 280 aa, Artificial
  Substituion in SEQ ID NO 477
MNGVSRFGGAETRKRFVLRYRSGEYRQEEDVIATEFALTLFVNGEEFSTLVCTPTYAEDLVYGFLASEGVIRDVDDVESIRVSLWTGTARVQTKSGAVLSPALYNKRYIGSCCGKGRQSFYFQSDALTARPVEDPVSLSADDVFRAMDLLDASSGLFEETGGVHVAALVREGQLVLARADIGRHNALDKIYGHCLRAGERLSGTAVAFSGRISSEVLLKVAKIGVGVVIARGAPTLLAVDLAEELNITAIGFVRGRAFNVYSHPWRLADAKKAQGAIEGA

SEQ ID NO: 486 - protein, 280 aa, Artificial
  Substituion in SEQ ID NO 477
MNGVSRFGGAETRRRFVLRYRSGEYRQEEDVIATEFALTLFVNGEEFSTLVCTPTYAEDLVYGFLASEGVIRDVDDVESIRVSLWTGTARVQTKSGAVLSPALYNKRYIGSCCGKGRQSFYFNSDALTARPVEDPVSLSADDVFRAMDLLDASSGLFEETGGVHVAALVREGQLVLARADIGRHNALDKIYGHCLRAGERLSGTAVAFSGRISSEVLLKVAKIGVGVVIARGAPTLLAVDLAEELNITAIGFVRGRAFNVYSHPWRLADAKKAQGAIEGA

SEQ ID NO: 487 - protein, 280 aa, Artificial
  Substituion in SEQ ID NO 477
MNGVSRFGGAETRRRFVLRYRSGEYRQEEDVIATEFALTLFVNGEEFSTLVCTPTYAEDLVYGFLASEGVIRDVDDVESIRVSLWTGTARVQTKSGAVLSPALYNKRYIGSCCGKGRQSFYFQSDALTARPVEDPVSLSADDVFRAMDLLDASSGLFEETGGVHVAALVREGQLVLARADIGRHNALDKIYGHCLRAGEKLSGTAVAFSGRISSEVLLKVAKIGVGVVIARGAPTLLAVDLAEELNITAIGFVRGRAFNVYSHPWRLADAKKAQGAIEGA

SEQ ID NO: 488 - protein, 280 aa, Artificial
  Substituion in SEQ ID NO 477
MNGVSRFGGAETRRRFVLRYRSGEYRQEEDVIATEFALTLFVNGEEFSTLVCTPTYAEDLVYGFLASEGVIRDVDDVESIRVSLWTGTARVQTKSGAVLSPALYQKRYIGSCCGKGRQSFYFQSDALTARPVEDPVSLSADDVFRAMDLLDASSGLFEETGGVHVAALVREGQLVLARADIGRHNALDKIYGHCLRAGERLSGTAVAFSGRISSEVLLKVAKIGVGVVIARGAPTLLAVDLAEELNITAIGFVRGRAFNVYSHPWRLADAKKAQGAIEGA

SEQ ID NO: 489 - DNA, 843 bp, Artificial
  Substituion in SEQ ID NO 478
gtgaatggcgtgtcgcgctttgggggagcggaaacgcggaggcgcttcgtgctccgatatcggtccggggagtataaacaggaggaggacgtgatcgcgacggaattcgcactcacgctgttcgtcaacggcgaggagttctcgacgctcgtgtgcacgccgacctacgcggaggacctggtgtatggctttctcgcttcggaaggcgtcatccgcgacgtggacgacgtcgagtcgattcgggtgagcctgtggacgggaacggcccgtgtacagacgaagtccggcgcggtgctttccccggcgctttacaacaaacggtacatcgggtcttgttgcgggaaggggcgacagagcttctatttccagagcgacgccctgaccgcgcgacccgtcgaggatccggtgtcgctctcggcggacgacgtgtttcgggcgatggatctcctcgacgcgtcgtccgggctgttcgaggaaacgggcggtgtgcacgtggcggcgctggtgcgtgaaggacagctcgtcttggcgagggccgacattggccgccacaacgcgctcgacaagatctacggccactgcctccgggccggcgagaggttgtccggcaccgccgtggcgttcagcggccggatctcgtccgaggtgttgctcaaggtcgccaagatcggtgtgggcgtcgtgatcgcccgaggagctccgacgctgctcgccgtcgatctcgccgaggaactgaacatcacggccatcggttttgtgcgcggccgggccttcaacgtgtacagtcatccgtggcgcttggcggacgccaagaaggcgcagggcgccatcgaaggggcatga

SEQ ID NO: 490 - DNA, 843 bp, Artificial
  Substituion in SEQ ID NO 478
gtgaatggcgtgtcgcgctttgggggagcggaaacgcggaaacgcttcgtgctccgatatcggtccggggagtatcggcaggaggaggacgtgatcgcgacggaattcgcactcacgctgttcgtcaacggcgaggagttctcgacgctcgtgtgcacgccgacctacgcggaggacctggtgtatggctttctcgcttcggaaggcgtcatccgcgacgtggacgacgtcgagtcgattcgggtgagcctgtggacgggaacggcccgtgtacagacgaagtccggcgcggtgctttccccggcgctttacaacaaacggtacatcgggtcttgttgcgggaaggggcgacagagcttctatttccagagcgacgccctgaccgcgcgacccgtcgaggatccggtgtcgctctcggcggacgacgtgtttcgggcgatggatctcctcgacgcgtcgtccgggctgttcgaggaaacgggcggtgtgcacgtggcggcgctggtgcgtgaaggacagctcgtcttggcgagggccgacattggccgccacaacgcgctcgacaagatctacggccactgcctccgggccggcgagaggttgtccggcaccgccgtggcgttcagcggccggatctcgtccgaggtgttgctcaaggtcgccaagatcggtgtgggcgtcgtgatcgcccgaggagctccgacgctgctcgccgtcgatctcgccgaggaactgaacatcacggccatcggttttgtgcgcggccgggccttcaacgtgtacagtcatccgtggcgcttggcggacgccaagaaggcgcagggcgccatcgaaggggcatga

SEQ ID NO: 491 - DNA, 843 bp, Artificial
  Substituion in SEQ ID NO 478
gtgaatggcgtgtcgcgctttgggggagcggaaacgcggaggcgcttcgtgctccgatatcggtccggggagtatcggcaggaggaggacgtgatcgcgacggaattcgcactcacgctgttcgtcaacggcgaggagttctcgacgctcgtgtgcacgccgacctacgcggaggacctggtgtatggctttctcgcttcggaaggcgtcatccgcgacgtggacgacgtcgagtcgattcgggtgagcctgtggacgggaacggcccgtgtacagacgaagtccggcgcggtgctttccccggcgctttacaacaaacggtacatcgggtcttgttgcgggaaggggcgacagagcttctatttcaatagcgacgccctgaccgcgcgacccgtcgaggatccggtgtcgctctcggcggacgacgtgtttcgggcgatggatctcctcgacgcgtcgtccgggctgttcgaggaaacgggcggtgtgcacgtggcggcgctggtgcgtgaaggacagctcgtcttggcgagggccgacattggccgccacaacgcgctcgacaagatctacggccactgcctccgggccggcgagaggttgtccggcaccgccgtggcgttcagcggccggatctcgtccgaggtgttgctcaaggtcgccaagatcggtgtgggcgtcgtgatcgcccgaggagctccgacgctgctcgccgtcgatctcgccgaggaactgaacatcacggccatcggttttgtgcgcggccgggccttcaacgtgtacagtcatccgtggcgcttggcggacgccaagaaggcgcagggcgccatcgaaggggcatga

SEQ ID NO: 492 - DNA, 843 bp, Artificial
  Substituion in SEQ ID NO 478
gtgaatggcgtgtcgcgctttgggggagcggaaacgcggaggcgcttcgtgctccgatatcggtccggggagtatcggcaggaggaggacgtgatcgcgacggaattcgcactcacgctgttcgtcaacggcgaggagttctcgacgctcgtgtgcacgccgacctacgcggaggacctggtgtatggctttctcgcttcggaaggcgtcatccgcgacgtggacgacgtcgagtcgattcgggtgagcctgtggacgggaacggcccgtgtacagacgaagtccggcgcggtgctttccccggcgctttacaacaaacggtacatcgggtcttgttgcgggaaggggcgacagagcttctatttccagagcgacgccctgaccgcgcgacccgtcgaggatccggtgtcgctctcggcggacgacgtgtttcgggcgatggatctcctcgacgcgtcgtccgggctgttcgaggaaacgggcggtgtgcacgtggcggcgctggtgcgtgaaggacagctcgtcttggcgagggccgacattggccgccacaacgcgctcgacaagatctacggccactgcctccgggccggcgagaaattgtccggcaccgccgtggcgttcagcggccggatctcgtccgaggtgttgctcaaggtcgccaagatcggtgtgggcgtcgtgatcgcccgaggagctccgacgctgctcgccgtcgatctcgccgaggaactgaacatcacggccatcggttttgtgcgcggccgggccttcaacgtgtacagtcatccgtggcgcttggcggacgccaagaaggcgcagggcgccatcgaaggggcatga

SEQ ID NO: 493 - DNA, 843 bp, Artificial
  Substituion in SEQ ID NO 478
gtgaatggcgtgtcgcgctttgggggagcggaaacgcggaggcgcttcgtgctccgatatcggtccggggagtatcggcaggaggaggacgtgatcgcgacggaattcgcactcacgctgttcgtcaacggcgaggagttctcgacgctcgtgtgcacgccgacctacgcggaggacctggtgtatggctttctcgcttcggaaggcgtcatccgcgacgtggacgacgtcgagtcgattcgggtgagcctgtggacgggaacggcccgtgtacagacgaagtccggcgcggtgctttccccggcgctttaccaaaaacggtacatcgggtcttgttgcgggaaggggcgacagagcttctatttccagagcgacgccctgaccgcgcgacccgtcgaggatccggtgtcgctctcggcggacgacgtgtttcgggcgatggatctcctcgacgcgtcgtccgggctgttcgaggaaacgggcggtgtgcacgtggcggcgctggtgcgtgaaggacagctcgtcttggcgagggccgacattggccgccacaacgcgctcgacaagatctacggccactgcctccgggccggcgagaggttgtccggcaccgccgtggcgttcagcggccggatctcgtccgaggtgttgctcaaggtcgccaagatcggtgtgggcgtcgtgatcgcccgaggagctccgacgctgctcgccgtcgatctcgccgaggaactgaacatcacggccatcggttttgtgcgcggccgggccttcaacgtgtacagtcatccgtggcgcttggcggacgccaagaaggcgcagggcgccatcgaaggggcatga

SEQ ID NO: 494 - protein, 249 aa, Alicyclobacillus acidocaldarius
MAKGGERMDKAGGIRVALAGALGRMGQVALEALRREDDIAICGVLVRRADEEAERRLSTYGAVYDDPERLIDTEEPDVWVDLTGPASVVRHVDLALSRGVRAVVGATGYTDEDVRRWDEMARHRQVGAAVCPNFAIGALLMMRFAREAARFLPRAEIIELHHDGKRDKPSGTSLRTKAMMEVEYDVPIHSVRLPGLVAHQEVIFGGAGEVLTIRHDSLSRESFMPGLILAVRRVMTLRALVYGLDKLLW

SEQ ID NO: 495 - DNA, 750 bp, Alicyclobacillus acidocaldarius
atggccaaggggggcgagcggatggataaggcgggtggcatccgggtggcactggcaggagcgctgggccgcatggggcaggtggcgctcgaggcgcttcggcgcgaggacgacatcgccatctgcggggtgttggtgcggcgcgccgacgaagaagccgagcgaaggctctccacttacggcgcggtgtacgacgacccggagcgactgatcgacacggaagagcccgacgtgtgggtggacctgaccggcccagcgtcggtggttcgccatgtcgatctggccctttctcgcggcgtgcgggcggtggtgggggcgaccggttacaccgacgaggacgtgcgcagatgggacgaaatggcgcgccatcggcaagtcggcgcggccgtctgcccgaacttcgcgataggggcgcttctcatgatgcgattcgcgcgcgaggcggcgcgcttcctgccgcgcgcggagatcattgagcttcaccatgacggcaagcgggacaagccgtccggcacgtcgctgaggacgaaggccatgatggaggtcgagtacgacgtgccgattcacagcgtgcgcctgccggggcttgtggcgcaccaagaagtgattttcggcggcgccggcgaagtgctgaccattcgtcacgattcccttagccgcgagagcttcatgcccggcctcatcctggccgtgcggcgcgtcatgacgcttcgcgcgctggtgtacgggttggacaaactcctctggtga

SEQ ID NO: 496 - protein, 262 aa, Geobacillus kaustophilus HTA426
IRIAIAGPRGRMGREAVALVQQTDHFELAAVIDRRYDGQNLAEIDGFSGVNAPIYTDAARCFAEVKPDVLIDLTTPEAGKRHTELALRYGVRPVVGTTGFTPEDIERLTKLAEEKEIGAIIAPNFAVGAVLMMKFARMAAKYFTDVEIIELHHDQKLDAPSGTALKTAQLIAEVRPSKKQGHPNEKETLAGARGAEYDGIPIHSVRLPGFVAHQEVIFGGNGQTLTIRHDSFDRRSFMSGVKLAVETVMHLHTLVYGLEHIL

SEQ ID NO: 497 - protein, 262 aa, Geobacillus thermodenitrificans NG80-2
IRIVIAGPRGRMGREAVALVQRTDHFELAAVIDRRYDGQNLADIDGFAGIDAPIYTDAVRCFTEVKPDVLIDLTTPEVGKRHAELALRYGVRPVIGTTGFTPEDIERLTELAETNEIGAIIAPNFAVGAVLMMKFARMAAKYFTDVEIIELHHDQKLDAPSGTALKTAQLIAEVRPSKKQGHPDEKETLAGARGAAYDGIPIHSVRLPGFVAHQEVIFGGEGQTLTIRHDSLDRRSFMSGVKLAVETVMHLHTLVYGLEHIL

SEQ ID NO: 498 - protein, 262 aa, Bacillus halodurans C-125
IKVAVAGPRGKMGREAVKMIHEADTLELVAVVDSKHDGMLVRQLDGLPPSDAPVYNELERCLTSQTIDVLVDLTTPAHGKRHMEIALDHGVRPVVGTTGFTDEDITNLRKKAEEKGIGAIIAPNFAIGAILMMKFAQTAAKYLPDVEIIEMHHDRKLDAPSGTALKTAQLISEVRKAKQQGHPDETEELKGARGADFEGMSIHSVRLPGLVAHQEVLFGGVGQTLKIRHDSMNRESFMPGVKLSIETVMGIDTLVYGLENII

SEQ ID NO: 499 - protein, 262 aa, Bacillus coagulans 36D1
IRIIVAGARGKMGSEAVRLIERTEHFKLVGVVDRTFDGKLFNDVSDYNGEPVRVYTDPEACLENCPADVWIDLTVPKAGFLHAKTALAHGVRPVVGTTGFTDAELEELKAVSAQKGIGCIIAPNFAIGAVLMMKFAQMAAKYFPDVEIIELHHDRKKDAPSGTSVKTAQMISEARRKKTQGHPDEKETLQGARGADFEGMHIHSVRLPGLVAHQEVLFGGDGQLLTIRHDSMDRASFMSGVKVAVETVMNLNTFVYGLENIL

SEQ ID NO: 500 - protein, 261 aa, Bacillus clausii KSM-K16
RIVIAGPRGNMGQEAVKLCLREESFELVAVVDSKNDGKQLKGLQEFQQGDVPVYTDMARCFAEHEPDVLIDLTAPAFGRKHMEVAFEHGVRPVVGTTGFSDEDIRDLTKLAEAKELGAIIAPNFAIGAILMMKFAQTAARYMNDVEIIEQHHDRKLDAPSGTAVKTAQLIAEVRAPKKQGHEQEREEMAGARGADFDGMKIHSVRLPGRVAHQEVLFGGVGQTLSIRHDSLNRESFMPGVKLAVEQVVKLSTLVYGLENLI

SEQ ID NO: 501 - protein, 249 aa, Artificial
  Substituion in SEQ ID NO 494
MAKGGERMDKAGGIRVALAGALGRMGQVALEALKREDDIAICGVLVRRADEEAERRLSTYGAVYDDPERLIDTEEPDVWVDLTGPASVVRHVDLALSRGVRAVVGATGYTDEDVRRWDEMARHRQVGAAVCPNFAIGALLMMRFAREAARFLPRAEIIELHHDGKRDKPSGTSLRTKAMMEVEYDVPIHSVRLPGLVAHQEVIFGGAGEVLTIRHDSLSRESFMPGLILAVRRVMTLRALVYGLDKLLW

SEQ ID NO: 502 - protein, 249 aa, Artificial
  Substituion in SEQ ID NO 494
MAKGGERMDKAGGIRVALAGALGRMGQVALDALRREDDIAICGVLVRRADEEAERRLSTYGAVYDDPERLIDTEEPDVWVDLTGPASVVRHVDLALSRGVRAVVGATGYTDEDVRRWDEMARHRQVGAAVCPNFAIGALLMMRFAREAARFLPRAEIIELHHDGKRDKPSGTSLRTKAMMEVEYDVPIHSVRLPGLVAHQEVIFGGAGEVLTIRHDSLSRESFMPGLILAVRRVMTLRALVYGLDKLLW

SEQ ID NO: 503 - protein, 249 aa, Artificial
  Substituion in SEQ ID NO 494
MAKGGERMDKAGGIRVALAGALGRMGQVALEALRREDDIAICGVLVRRADEEAERRLSTYGAVYDDPERLIDTEEPDVWVDLTGPASVVRHVDLALSRGVRAVVGATGYTDEDVRRWDEMARHRQVGAAVCPNFAIGALLMMRFAREAARFLPRAEIIELHHDGKRDRPSGTSLRTKAMMEVEYDVPIHSVRLPGLVAHQEVIFGGAGEVLTIRHDSLSRESFMPGLILAVRRVMTLRALVYGLDKLLW

SEQ ID NO: 504 - protein, 249 aa, Artificial
  Substituion in SEQ ID NO 494
MAKGGERMDKAGGIRVALAGALGRMGQVALEALRREDDIAICGVLVRRADDEAERRLSTYGAVYDDPERLIDTEEPDVWVDLTGPASVVRHVDLALSRGVRAVVGATGYTDEDVRRWDEMARHRQVGAAVCPNFAIGALLMMRFAREAARFLPRAEIIELHHDGKRDKPSGTSLRTKAMMEVEYDVPIHSVRLPGLVAHQEVIFGGAGEVLTIRHDSLSRESFMPGLILAVRRVMTLRALVYGLDKLLW

SEQ ID NO: 505 - protein, 249 aa, Artificial
  Substituion in SEQ ID NO 494
MAKGGERMDKAGGIRVALAGALGRMGQVALEALRREDDIAICGVLVRRADEEAERRLSTYGAVYDDPERLIDTEEPDVWVDLTGPASVVRHVDLALSRGVRAVVGATGYTDEDVRRWDEMARHRQVGAAVCPNFAIGALLMMRFAREAARFLPRAEIIELHHDGKRDKPSGTSLRTKAMMEVEYDVPIHSVRLPGIVAHQEVIFGGAGEVLTIRHDSLSRESFMPGLILAVRRVMTLRALVYGLDKLLW

SEQ ID NO: 506 - DNA, 750 bp, Artificial
  Substituion in SEQ ID NO 495
atggccaaggggggcgagcggatggataaggcgggtggcatccgggtggcactggcaggagcgctgggccgcatggggcaggtggcgctcgaggcgcttaaacgcgaggacgacatcgccatctgcggggtgttggtgcggcgcgccgacgaagaagccgagcgaaggctctccacttacggcgcggtgtacgacgacccggagcgactgatcgacacggaagagcccgacgtgtgggtggacctgaccggcccagcgtcggtggttcgccatgtcgatctggccctttctcgcggcgtgcgggcggtggtgggggcgaccggttacaccgacgaggacgtgcgcagatgggacgaaatggcgcgccatcggcaagtcggcgcggccgtctgcccgaacttcgcgataggggcgcttctcatgatgcgattcgcgcgcgaggcggcgcgcttcctgccgcgcgcggagatcattgagcttcaccatgacggcaagcgggacaagccgtccggcacgtcgctgaggacgaaggccatgatggaggtcgagtacgacgtgccgattcacagcgtgcgcctgccggggcttgtggcgcaccaagaagtgattttcggcggcgccggcgaagtgctgaccattcgtcacgattcccttagccgcgagagcttcatgcccggcctcatcctggccgtgcggcgcgtcatgacgcttcgcgcgctggtgtacgggttggacaaactcctctggtga

SEQ ID NO: 507 - DNA, 750 bp, Artificial
  Substituion in SEQ ID NO 495
atggccaaggggggcgagcggatggataaggcgggtggcatccgggtggcactggcaggagcgctgggccgcatggggcaggtggcgctcgatgcgcttcggcgcgaggacgacatcgccatctgcggggtgttggtgcggcgcgccgacgaagaagccgagcgaaggctctccacttacggcgcggtgtacgacgacccggagcgactgatcgacacggaagagcccgacgtgtgggtggacctgaccggcccagcgtcggtggttcgccatgtcgatctggccctttctcgcggcgtgcgggcggtggtgggggcgaccggttacaccgacgaggacgtgcgcagatgggacgaaatggcgcgccatcggcaagtcggcgcggccgtctgcccgaacttcgcgataggggcgcttctcatgatgcgattcgcgcgcgaggcggcgcgcttcctgccgcgcgcggagatcattgagcttcaccatgacggcaagcgggacaagccgtccggcacgtcgctgaggacgaaggccatgatggaggtcgagtacgacgtgccgattcacagcgtgcgcctgccggggcttgtggcgcaccaagaagtgattttcggcggcgccggcgaagtgctgaccattcgtcacgattcccttagccgcgagagcttcatgcccggcctcatcctggccgtgcggcgcgtcatgacgcttcgcgcgctggtgtacgggttggacaaactcctctggtga

SEQ ID NO: 508 - DNA, 750 bp, Artificial
  Substituion in SEQ ID NO 495
atggccaaggggggcgagcggatggataaggcgggtggcatccgggtggcactggcaggagcgctgggccgcatggggcaggtggcgctcgaggcgcttcggcgcgaggacgacatcgccatctgcggggtgttggtgcggcgcgccgacgaagaagccgagcgaaggctctccacttacggcgcggtgtacgacgacccggagcgactgatcgacacggaagagcccgacgtgtgggtggacctgaccggcccagcgtcggtggttcgccatgtcgatctggccctttctcgcggcgtgcgggcggtggtgggggcgaccggttacaccgacgaggacgtgcgcagatgggacgaaatggcgcgccatcggcaagtcggcgcggccgtctgcccgaacttcgcgataggggcgcttctcatgatgcgattcgcgcgcgaggcggcgcgcttcctgccgcgcgcggagatcattgagcttcaccatgacggcaagcgggaccgtccgtccggcacgtcgctgaggacgaaggccatgatggaggtcgagtacgacgtgccgattcacagcgtgcgcctgccggggcttgtggcgcaccaagaagtgattttcggcggcgccggcgaagtgctgaccattcgtcacgattcccttagccgcgagagcttcatgcccggcctcatcctggccgtgcggcgcgtcatgacgcttcgcgcgctggtgtacgggttggacaaactcctctggtga

SEQ ID NO: 509 - DNA, 750 bp, Artificial
  Substituion in SEQ ID NO 495
atggccaaggggggcgagcggatggataaggcgggtggcatccgggtggcactggcaggagcgctgggccgcatggggcaggtggcgctcgaggcgcttcggcgcgaggacgacatcgccatctgcggggtgttggtgcggcgcgccgacgatgaagccgagcgaaggctctccacttacggcgcggtgtacgacgacccggagcgactgatcgacacggaagagcccgacgtgtgggtggacctgaccggcccagcgtcggtggttcgccatgtcgatctggccctttctcgcggcgtgcgggcggtggtgggggcgaccggttacaccgacgaggacgtgcgcagatgggacgaaatggcgcgccatcggcaagtcggcgcggccgtctgcccgaacttcgcgataggggcgcttctcatgatgcgattcgcgcgcgaggcggcgcgcttcctgccgcgcgcggagatcattgagcttcaccatgacggcaagcgggacaagccgtccggcacgtcgctgaggacgaaggccatgatggaggtcgagtacgacgtgccgattcacagcgtgcgcctgccggggcttgtggcgcaccaagaagtgattttcggcggcgccggcgaagtgctgaccattcgtcacgattcccttagccgcgagagcttcatgcccggcctcatcctggccgtgcggcgcgtcatgacgcttcgcgcgctggtgtacgggttggacaaactcctctggtga

SEQ ID NO: 510 - DNA, 750 bp, Artificial
  Substituion in SEQ ID NO 495
atggccaaggggggcgagcggatggataaggcgggtggcatccgggtggcactggcaggagcgctgggccgcatggggcaggtggcgctcgaggcgcttcggcgcgaggacgacatcgccatctgcggggtgttggtgcggcgcgccgacgaagaagccgagcgaaggctctccacttacggcgcggtgtacgacgacccggagcgactgatcgacacggaagagcccgacgtgtgggtggacctgaccggcccagcgtcggtggttcgccatgtcgatctggccctttctcgcggcgtgcgggcggtggtgggggcgaccggttacaccgacgaggacgtgcgcagatgggacgaaatggcgcgccatcggcaagtcggcgcggccgtctgcccgaacttcgcgataggggcgcttctcatgatgcgattcgcgcgcgaggcggcgcgcttcctgccgcgcgcggagatcattgagcttcaccatgacggcaagcgggacaagccgtccggcacgtcgctgaggacgaaggccatgatggaggtcgagtacgacgtgccgattcacagcgtgcgcctgccggggattgtggcgcaccaagaagtgattttcggcggcgccggcgaagtgctgaccattcgtcacgattcccttagccgcgagagcttcatgcccggcctcatcctggccgtgcggcgcgtcatgacgcttcgcgcgctggtgtacgggttggacaaactcctctggtga

SEQ ID NO: 511 - protein, 307 aa, Alicyclobacillus acidocaldarius
MGERRGFGLKKLSAAIVGSGNIGTDLMIKLKRSPWIEPRWMIGIDPESDGLRRAREMGLETSADGLKAVLEQGVRPDIVFDATSAKAHVRHAKLLREAGIQAVDLTPAARGPYVIAAVNLEEHLDSPNVNMVTCGGQATVPMVYAVSRVVGVRYAEIVATIASKSAGPGTRANIDEFTQTTARALEAIGGAKRGKAIIILNPAEPPILMRDTIYCLMEDASPTTQAKVLESIEQMVRHVQTFVPGYRLNREPIFQDDLVSISIEVEGLGDYLPVYAGNLDIMTAAAVKFGEEYARHKMQVASAEEAR

SEQ ID NO: 512 - DNA, 924 bp, Alicyclobacillus acidocaldarius
gtgggcgaaaggagagggttcggattgaagaagctcagtgccgcgatcgtcgggtccggaaacatcgggacggatctcatgatcaagctgaagcgaagcccgtggattgaaccgcgctggatgatcggcatcgacccggaatcggatggccttcggcgcgcgcgcgagatggggcttgagacgtcggccgacggactcaaggcggtcctcgaacaaggggtgcgcccggacatcgtctttgacgcgacgagcgcgaaggcgcacgtgcgccatgccaaactgcttcgcgaagcaggcatccaggcggtcgacttgacgccggcagcgcgcgggccgtacgtcatcgcggcggtcaacctggaggagcacctcgactcgccgaacgttaacatggtcacctgcggcggccaggccaccgtgccgatggtgtacgccgtcagccgggtggtcggggtgcgttacgcggagattgtcgccaccatcgccagcaagagcgcgggccccggcacgcgggcgaacatcgacgagttcacccagacgacggcgcgcgcgctggaggccatcggaggcgcaaagcgagggaaggccatcatcatcctcaacccggcggaaccccccatcctcatgcgcgacaccatctactgcttgatggaagacgcgagcccgaccacccaggcgaaggtgctcgagtccatcgaacagatggtgcgccacgtgcagacattcgtccctgggtatcggttgaaccgcgagcccatcttccaggacgatctcgtcagcatctccatcgaggtcgagggcctcggcgattacctgccggtgtacgcggggaacctcgacatcatgaccgcggcggcagtgaagtttggcgaagagtacgcgcgtcacaagatgcaggtggcgtcggcggaagaagcgaggtga

SEQ ID NO: 513 - protein, 298 aa, Mycobacterium gilvum PYR-GCK
KLSVAIVGSGNISTDLLYKLLRSEWLEPRWMIGIDPESEGLARARKLGLETSHEGVDWLLARDEKPDMVFEATSAYVHRDAAPRYAEAGIRAIDLTPAAIGPGVIPPANLREHLDAPNVNMVTCGGQATIPMVHAVSRVVDVPYAEIVASVSSASAGPGTRANIDEFTKTTSAGVEVIGGARRGKAIIILNPADPPMIMRDTIFCAIPEDADHAAITQSVKDVVAEVQTYVPGYRLLNEPQFDEPSVVNGGNHLVTIFVEVEGAGDYLPPYAGNLDIMTAAAAKVGEEIARERVATST

SEQ ID NO: 514 - protein, 304 aa, Mycobacterium smegmatis str. MC2 155
KKSSVAIVGSGNISTDLLYKLLRSEWLEPRWMIGIDPESEGLARARKLGLETSAEGVDWLLAQSEKPDLVFEATSAYVHRDAAPRYEEAGIRAIDLTPAAVGPGVVPPANLRDHLDAPNVNMVTCGGQATIPIVHAVSRVVDVPYAEIVASVSSASAGPGTRANIDEFTKTTSAGVQNIGGAQRGKAIIVLNPAEPPMIMRDTIFCAIPEGADHDAITQSIKDVVAEVQTYVPGYRLLNEPQFDEPSVVNGGNHLVTTFVEVEGAGDYLPPYAGNLDIMTAAATKVGEEIAKKSAEASLASGAQ

SEQ ID NO: 515 - protein, 298 aa, Rhodococcus sp. RHA1
MTKASVAIVGSGNISTDLLYKLQRSEWLEPRWMIGIDPESEGLARARKLGLETSAEGVDWLLNQPEKPDLVFEATSAYVHREAAPRYEAAGIRAVDLTPAAVGPAVVPPANLREHLGAPNVNMITCGGQATIPIVYAVSRVVDVPYAEIVASVASVSAGPGTRANIDEFTKTTSRGIETIGGAQRGKAIIILNPADPPMIMRDTIFCAIPEDADRAAITDSIHRVVADIQQYVPGYRLLNEPQFDDPSVVSGGQATVTTFVEVEGAGDFLPPYAGNLDIMTAAATKVGEEIAQKLLSV

SEQ ID NO: 516 - protein, 294 aa, Mycobacterium vanbaalenii PYR-1
KKSVAIVGSGNISTDLLYKLLRSEWLEPRWMIGIDPESEGLARARKLGLETSHEGVDWLLAQSELPDMVFEATSAYVHKAAAPRYAEAGIRAIDLTPAAVGPGVIPPANLRAHLDAPNVNMVTCGGQATIPMVYAVSRVVEVPYAEIVASVSSASAGPGTRANIDEFTKTTSAGVQNIGGAQRGKAIIILNPAEPPMIMRDTIFCAIPEHADHAAITQSIKDVVAEVQTYVPGYRLLNEPQFDEPSVVNGGNHVVTVFVEVEGAGDYLPPYAGNLDIMTAAATKVGEEIAKESL

SEQ ID NO: 517 - protein, 297 aa, Mycobacterium avium 104
KAKVAIVGSGNISTDLLYKLLRSDWLEPRWMVGIDPQSEGLARARKLGLETTHEGVDWLLAQPEKPDLVFEATSAYVHRDAAPKYEAAGIRAIDLTPAAVGPAVIPPANLRQHLDAPNVNMITCGGQATIPIVYAVSRVVEVPYAEIVASVASVSAGPGTRANIDEFTKTTSRGVETIGGAKRGKAIIILNPADPPMIMRDTIFCAIPEDADRDAIAQSIHDVVKEVQSYVPGYRLLNEPQFDDPSLNSGGQALVTTFVEVEGAGDYLPPYAGNLDIMTAAATKVGEEIAKETLSVA

SEQ ID NO: 518 - protein, 307 aa, Artificial
  Substituion in SEQ ID NO 511
MGDRRGFGLKKLSAAIVGSGNIGTDLMIKLKRSPWIEPRWMIGIDPESDGLRRAREMGLETSADGLKAVLEQGVRPDIVFDATSAKAHVRHAKLLREAGIQAVDLTPAARGPYVIAAVNLEEHLDSPNVNMVTCGGQATVPMVYAVSRVVGVRYAEIVATIASKSAGPGTRANIDEFTQTTARALEAIGGAKRGKAIIILNPAEPPILMRDTIYCLMEDASPTTQAKVLESIEQMVRHVQTFVPGYRLNREPIFQDDLVSISIEVEGLGDYLPVYAGNLDIMTAAAVKFGEEYARHKMQVASAEEAR

SEQ ID NO: 519 - protein, 307 aa, Artificial
  Substituion in SEQ ID NO 511
MGERRGFGLKKLSAAIVGSGNIGTDLMIKLKRSPWIEPRWMIGIDPESDGLRRAREMGLETSADGLKAVLEQGVRPDIVFDATSAKAHVRHAKLLREAGIQAVDLTPAARGPYVIAAVNLEEHLDSPNVNMVTCGGQATVPMVYAVSRVVGVRYAEIVATIASKSAGPGTRANIDEFTQTTARALEAIGGAKRGKAIIILNPAEPPILMRDTIYCIMEDASPTTQAKVLESIEQMVRHVQTFVPGYRLNREPIFQDDLVSISIEVEGLGDYLPVYAGNLDIMTAAAVKFGEEYARHKMQVASAEEAR

SEQ ID NO: 520 - protein, 307 aa, Artificial
  Substituion in SEQ ID NO 511
MGERRGFGLKKLSAAIVGSGNIGTDLMIKLKRSPWIEPRWMIGIDPESDGLRRAREMGLETSADGLKAVLEQGVRPDIVFDATSAKAHVRHAKLLRDAGIQAVDLTPAARGPYVIAAVNLEEHLDSPNVNMVTCGGQATVPMVYAVSRVVGVRYAEIVATIASKSAGPGTRANIDEFTQTTARALEAIGGAKRGKAIIILNPAEPPILMRDTIYCLMEDASPTTQAKVLESIEQMVRHVQTFVPGYRLNREPIFQDDLVSISIEVEGLGDYLPVYAGNLDIMTAAAVKFGEEYARHKMQVASAEEAR

SEQ ID NO: 521 - protein, 307 aa, Artificial
  Substituion in SEQ ID NO 511
MGERRGFGLKKLSAAIVGSGNIGTDLMIKLKRSPWIEPRWMIGIDPESDGLRRAREMGLETSADGLKAVLEQGVRPDIVFDATSAKAHVRHAKLLREAGIQAVDLTPAARGPYVIAAVNLEEHLDSPNVNMVTCGGQATVPMVYAVSRVVGVRYAEIVATIASKSAGPGTRANIDEFTQTTARALEAIGGAKRGKAIIILNPAEPPILMRDTIYCLMEDASPTTQAKVLESIEQMVKHVQTFVPGYRLNREPIFQDDLVSISIEVEGLGDYLPVYAGNLDIMTAAAVKFGEEYARHKMQVASAEEAR

SEQ ID NO: 522 - protein, 307 aa, Artificial
  Substituion in SEQ ID NO 511
MGERRGFGLKKLSAAIVGSGNIGTDLMIKLKRSPWIEPRWMIGIDPESDGLRRAREMGLETSADGLKAVLEQGVRPDIVFDATSAKAHVRHAKLLREAGIQAVDLTPAARGPYVIAAVNLEEHLDSPNVNMVTCGGQATVPMVYAVSRVVGVRYAEIVATIASRSAGPGTRANIDEFTQTTARALEAIGGAKRGKAIIILNPAEPPILMRDTIYCLMEDASPTTQAKVLESIEQMVRHVQTFVPGYRLNREPIFQDDLVSISIEVEGLGDYLPVYAGNLDIMTAAAVKFGEEYARHKMQVASAEEAR

SEQ ID NO: 523 - DNA, 924 bp, Artificial
  Substituion in SEQ ID NO 512
gtgggcgataggagagggttcggattgaagaagctcagtgccgcgatcgtcgggtccggaaacatcgggacggatctcatgatcaagctgaagcgaagcccgtggattgaaccgcgctggatgatcggcatcgacccggaatcggatggccttcggcgcgcgcgcgagatggggcttgagacgtcggccgacggactcaaggcggtcctcgaacaaggggtgcgcccggacatcgtctttgacgcgacgagcgcgaaggcgcacgtgcgccatgccaaactgcttcgcgaagcaggcatccaggcggtcgacttgacgccggcagcgcgcgggccgtacgtcatcgcggcggtcaacctggaggagcacctcgactcgccgaacgttaacatggtcacctgcggcggccaggccaccgtgccgatggtgtacgccgtcagccgggtggtcggggtgcgttacgcggagattgtcgccaccatcgccagcaagagcgcgggccccggcacgcgggcgaacatcgacgagttcacccagacgacggcgcgcgcgctggaggccatcggaggcgcaaagcgagggaaggccatcatcatcctcaacccggcggaaccccccatcctcatgcgcgacaccatctactgcttgatggaagacgcgagcccgaccacccaggcgaaggtgctcgagtccatcgaacagatggtgcgccacgtgcagacattcgtccctgggtatcggttgaaccgcgagcccatcttccaggacgatctcgtcagcatctccatcgaggtcgagggcctcggcgattacctgccggtgtacgcggggaacctcgacatcatgaccgcggcggcagtgaagtttggcgaagagtacgcgcgtcacaagatgcaggtggcgtcggcggaagaagcgaggtga

SEQ ID NO: 524 - DNA, 924 bp, Artificial
  Substituion in SEQ ID NO 512
gtgggcgaaaggagagggttcggattgaagaagctcagtgccgcgatcgtcgggtccggaaacatcgggacggatctcatgatcaagctgaagcgaagcccgtggattgaaccgcgctggatgatcggcatcgacccggaatcggatggccttcggcgcgcgcgcgagatggggcttgagacgtcggccgacggactcaaggcggtcctcgaacaaggggtgcgcccggacatcgtctttgacgcgacgagcgcgaaggcgcacgtgcgccatgccaaactgcttcgcgaagcaggcatccaggcggtcgacttgacgccggcagcgcgcgggccgtacgtcatcgcggcggtcaacctggaggagcacctcgactcgccgaacgttaacatggtcacctgcggcggccaggccaccgtgccgatggtgtacgccgtcagccgggtggtcggggtgcgttacgcggagattgtcgccaccatcgccagcaagagcgcgggccccggcacgcgggcgaacatcgacgagttcacccagacgacggcgcgcgcgctggaggccatcggaggcgcaaagcgagggaaggccatcatcatcctcaacccggcggaaccccccatcctcatgcgcgacaccatctactgcattatggaagacgcgagcccgaccacccaggcgaaggtgctcgagtccatcgaacagatggtgcgccacgtgcagacattcgtccctgggtatcggttgaaccgcgagcccatcttccaggacgatctcgtcagcatctccatcgaggtcgagggcctcggcgattacctgccggtgtacgcggggaacctcgacatcatgaccgcggcggcagtgaagtttggcgaagagtacgcgcgtcacaagatgcaggtggcgtcggcggaagaagcgaggtga

SEQ ID NO: 525 - DNA, 924 bp, Artificial
  Substituion in SEQ ID NO 512
gtgggcgaaaggagagggttcggattgaagaagctcagtgccgcgatcgtcgggtccggaaacatcgggacggatctcatgatcaagctgaagcgaagcccgtggattgaaccgcgctggatgatcggcatcgacccggaatcggatggccttcggcgcgcgcgcgagatggggcttgagacgtcggccgacggactcaaggcggtcctcgaacaaggggtgcgcccggacatcgtctttgacgcgacgagcgcgaaggcgcacgtgcgccatgccaaactgcttcgcgatgcaggcatccaggcggtcgacttgacgccggcagcgcgcgggccgtacgtcatcgcggcggtcaacctggaggagcacctcgactcgccgaacgttaacatggtcacctgcggcggccaggccaccgtgccgatggtgtacgccgtcagccgggtggtcggggtgcgttacgcggagattgtcgccaccatcgccagcaagagcgcgggccccggcacgcgggcgaacatcgacgagttcacccagacgacggcgcgcgcgctggaggccatcggaggcgcaaagcgagggaaggccatcatcatcctcaacccggcggaaccccccatcctcatgcgcgacaccatctactgcttgatggaagacgcgagcccgaccacccaggcgaaggtgctcgagtccatcgaacagatggtgcgccacgtgcagacattcgtccctgggtatcggttgaaccgcgagcccatcttccaggacgatctcgtcagcatctccatcgaggtcgagggcctcggcgattacctgccggtgtacgcggggaacctcgacatcatgaccgcggcggcagtgaagtttggcgaagagtacgcgcgtcacaagatgcaggtggcgtcggcggaagaagcgaggtga

SEQ ID NO: 526 - DNA, 924 bp, Artificial
  Substituion in SEQ ID NO 512
gtgggcgaaaggagagggttcggattgaagaagctcagtgccgcgatcgtcgggtccggaaacatcgggacggatctcatgatcaagctgaagcgaagcccgtggattgaaccgcgctggatgatcggcatcgacccggaatcggatggccttcggcgcgcgcgcgagatggggcttgagacgtcggccgacggactcaaggcggtcctcgaacaaggggtgcgcccggacatcgtctttgacgcgacgagcgcgaaggcgcacgtgcgccatgccaaactgcttcgcgaagcaggcatccaggcggtcgacttgacgccggcagcgcgcgggccgtacgtcatcgcggcggtcaacctggaggagcacctcgactcgccgaacgttaacatggtcacctgcggcggccaggccaccgtgccgatggtgtacgccgtcagccgggtggtcggggtgcgttacgcggagattgtcgccaccatcgccagcaagagcgcgggccccggcacgcgggcgaacatcgacgagttcacccagacgacggcgcgcgcgctggaggccatcggaggcgcaaagcgagggaaggccatcatcatcctcaacccggcggaaccccccatcctcatgcgcgacaccatctactgcttgatggaagacgcgagcccgaccacccaggcgaaggtgctcgagtccatcgaacagatggtgaaacacgtgcagacattcgtccctgggtatcggttgaaccgcgagcccatcttccaggacgatctcgtcagcatctccatcgaggtcgagggcctcggcgattacctgccggtgtacgcggggaacctcgacatcatgaccgcggcggcagtgaagtttggcgaagagtacgcgcgtcacaagatgcaggtggcgtcggcggaagaagcgaggtga

SEQ ID NO: 527 - DNA, 924 bp, Artificial
  Substituion in SEQ ID NO 512
gtgggcgaaaggagagggttcggattgaagaagctcagtgccgcgatcgtcgggtccggaaacatcgggacggatctcatgatcaagctgaagcgaagcccgtggattgaaccgcgctggatgatcggcatcgacccggaatcggatggccttcggcgcgcgcgcgagatggggcttgagacgtcggccgacggactcaaggcggtcctcgaacaaggggtgcgcccggacatcgtctttgacgcgacgagcgcgaaggcgcacgtgcgccatgccaaactgcttcgcgaagcaggcatccaggcggtcgacttgacgccggcagcgcgcgggccgtacgtcatcgcggcggtcaacctggaggagcacctcgactcgccgaacgttaacatggtcacctgcggcggccaggccaccgtgccgatggtgtacgccgtcagccgggtggtcggggtgcgttacgcggagattgtcgccaccatcgccagccgtagcgcgggccccggcacgcgggcgaacatcgacgagttcacccagacgacggcgcgcgcgctggaggccatcggaggcgcaaagcgagggaaggccatcatcatcctcaacccggcggaaccccccatcctcatgcgcgacaccatctactgcttgatggaagacgcgagcccgaccacccaggcgaaggtgctcgagtccatcgaacagatggtgcgccacgtgcagacattcgtccctgggtatcggttgaaccgcgagcccatcttccaggacgatctcgtcagcatctccatcgaggtcgagggcctcggcgattacctgccggtgtacgcggggaacctcgacatcatgaccgcggcggcagtgaagtttggcgaagagtacgcgcgtcacaagatgcaggtggcgtcggcggaagaagcgaggtga

SEQ ID NO: 528 - protein, 927 aa, Alicyclobacillus acidocaldarius
MSHGELAASARRPMCKRFAGWATRRPRQGGCKMAQVQDVQRDQALTTRWVYSFDQADPKNRSLLGGKGANLAQMVQWGFPVPPGFTITTEACNEYWARGGKFPEGLLDEVALAILRLERTAGKRFGDAFQPLLVSVRSGAPVSMPGMMDTILNLGLNDLTVRALANQSQDPAFAYDSYRRLIQMFANVVFNVSLEPFEHALRAAKAKHGVERDRDLPADAWKDLVATYLKLFAEHVGQPFPQDVNVQLELAIEAVFRSWNSPRAIVYRKAHGIPETLGTAVNVQAMVFGNMGDDSGTGVIFTRHPSTGEPVLFGEFLANAQGEDVVAGIRTPQPIADLAHTMPHVYESLVALAKQLETRFRDMQDVEFTVERGKLFVLQTRSGKRTAQAAVRIAIDMLHEGLIQPEEALLRVDAQHLRQLLHRRLQGTDALQVFAKGLPASPGASVGRIVLDADTAVEWAQRGEKVVLVRPETTPEDIHGVLAAEGVVTTHGGMTSHAAVVARGIGKPAVCGCDGVHIDFEARQVESNGVVLKEGDVISVDGGTGTVYVGEAQMEEAKMADELKELLSIADQVRRLKVRANADTPEDARRAREFGAEGIGLCRTEHMFLSPDRVPLVQRMILATTSAERQAALSKLLPLQVSDFTAIFEAMDGLPVTIRLLDPPLHEFLPREEELAERLEELRAQGASEDEIAETEQLLRQARYLREANPMMGLRGSRLGIVYPEIYDMQMEAIITAAAQAKRRGIAVDLEVMLPLIGSPKELRVLRERMEEIAKRTMEREGVEIEYRIGTMIEVPRAALTADQIAEDAQFFSFGTNDLTQMTFAFSRDDAEGKFLNVYLDREILPYNPFETLDTEGVGKLIQWAVEAGRKRRPDLKTGVCGEHGGDPASIAFCEDIGLDYVSCSPFRIPVARIAAAQAAVRKRMTG

SEQ ID NO: 529 - DNA, 2784 bp, Alicyclobacillus acidocaldarius
gtgtcacatggcgagctcgcggcaagcgcacggcgacccatgtgcaagcgcttcgccggatgggcgacacgaaggccgcgacaagggggatgcaagatggcgcaggtgcaggatgtacagcgcgatcaggcgctcacgacccggtgggtctattcctttgatcaagcagatccgaaaaaccgaagccttttgggcggcaaaggcgccaacttggcgcagatggttcaatgggggtttcccgtcccgcctggctttaccatcacgacggaggcttgcaacgaatattgggcgcggggcggcaagtttcccgaagggctgctggacgaggtggcgctcgccatcctgcggctcgagcgcacggccgggaagcgattcggcgacgcgtttcagccgctccttgtttccgtgcgctccggcgcgcccgtgtcgatgccgggcatgatggacaccattttgaatctgggcctcaatgatctgacggtgcgggcgctggcgaatcagtcgcaggatcccgcgttcgcctacgactcgtaccgccgcctgattcaaatgttcgcaaacgtggtgttcaacgtatcgctggagccgttcgaacacgcgcttagggcggcgaaggccaagcacggcgttgagcgcgatcgcgaccttccggccgacgcgtggaaggatctcgtggcgacgtacctgaaactgtttgcagaacacgtcggacagccgttcccgcaggacgtgaacgtgcaattggaactcgccatcgaggccgtgttccgctcgtggaacagcccgcgggccatcgtctatcgcaaggctcacggtatccctgagaccctcggcacagcggtcaacgttcaggccatggtgtttggcaacatgggcgacgacagcggcacgggcgtgatcttcacgcgccatccgtcgacgggcgagcccgtcttgttcggcgagttcttggccaacgctcagggcgaggacgtggtcgcgggcattcgcacgcctcaacccattgccgatctcgcccacaccatgccgcacgtgtacgagtcgcttgtggccctcgcgaaacagttggagacgcgcttccgggacatgcaggacgtcgagttcacggtggagcggggcaagctgttcgtgctgcagacgcggagcgggaagcgcacggcgcaggcggccgtccgcatcgccatcgacatgctgcatgaaggcctgattcagccggaagaggcgctcctgcgcgtcgacgcccagcatctgcgccagcttttgcaccggcggctgcagggaacggatgcactgcaggtgttcgccaaggggcttccggcgtctccaggcgcgagcgtgggccgaattgtgttggatgcggacacggcggtggagtgggcgcagcgcggcgagaaggtcgtcctcgtgaggcctgagacgacgcccgaggacatccacggcgtgctggccgcggaaggcgttgtgacgacgcacggtgggatgacgagccacgcggcggttgtggcccgcggaattggcaagccggcggtctgcggctgtgacggcgtgcacatcgacttcgaggcgcgtcaggtcgaatcgaacggcgtcgtgctgaaggaaggtgacgtcatctcggtggacggcggaaccgggacggtgtatgtcggagaggcgcagatggaagaagcgaaaatggcggacgagctgaaggagttgctgtccatcgcggaccaagtgcggcgcctcaaggtccgcgccaacgcggacacgccggaagacgcgcggcgcgcgcgagagttcggcgctgagggcattggcctgtgccgcacggaacacatgttcctgtcgccggatcgggtgccgctcgtgcagcgcatgattttggcgaccacgtcggctgagcgacaggcggccctgtcgaaactgctgccgctccaggtctcggatttcaccgccatcttcgaagcgatggacggcctgccggtgaccatacgtctgctggatccgccgctgcacgagttcctgccgcgcgaagaggagctggccgaacgcctcgaggagcttcgcgcgcagggcgcgtccgaggacgagatcgccgagacggaacagttgctccggcaagcccgatacctgcgggaggccaaccccatgatgggtctccgaggttctcggttgggcatcgtgtaccctgagatctacgatatgcagatggaggccatcatcacggccgcggcgcaggcgaaacgccgaggcatcgccgtcgacctggaagtgatgttgccgctcatcggctctccgaaggaacttcgcgttttgcgcgagcgcatggaggagatcgctaagcggacgatggagcgcgagggcgtcgagatcgaataccgcatcggcacgatgatcgaggtgccgcgcgccgcgctgacggcggaccagattgcggaggatgcgcagttcttctccttcggcaccaacgacctgacgcagatgacgttcgccttcagccgagacgacgccgaggggaaattcctcaacgtatacctggatcgggagatcttgccttacaacccgttcgagacgctggatacggagggcgtcggcaagctgattcaatgggcagtcgaagcggggcgcaagcgccgtcccgatttgaagaccggcgtgtgcggcgaacacgggggcgatccggcgtcgattgcgttctgcgaggacattgggctcgactacgtcagctgctcgcccttccgcatcccggtcgcgcggattgccgcggcgcaggcggccgtgcgcaaacgcatgacgggttga

SEQ ID NO: 530 - protein, 861 aa, Carboxydothermus hydrogenoformans Z-2901
TKYVYLFHEGRADMKDLLGGKGANLAEMTNIGLPVPPGMTITTEACREYYRLGGKFPEGLMEEVKEKLVYIEEKTGKKFGDPQNPLLVSVRSGAKFSMPGMMDTILNLGLNEETVEGLAQNTQNPRFAYDAYRRFIQMFGDVVLEIPKHEFEHILDRQKEKEGVTFDQELSAEALKEVITRYKELVERKTGKPFPSDPMVQLTMAIEAVFKSWNNDRAIVYRNLNKIPHDLGTAVNIQSMVFGNMGNDSGTGVAFTRNPSTGEKVLYGEYLTNAQGEDVVAGIRTPSPISKLKEEMPEVYEQFVSIAKLLESHYKNMQDIEFTIERGKLYILQTRNGKRTAQAAVKIAHDMVEEGLITKKEAILMVEPGQLDQLLHRQIDPSAKVEVIAKGLPASPGAASGIVVFDADEAEKLGKEGKKVLLVRTETTPDDIHGIVAAQGVLTSRGGMTSHAAVVARGMGKPCVCGCEAIKIDYEKKLFTVDNITVKEGDYLSIDGSTGRVILGTVPMKDPELSPEFIKLLEWADELKRLEVRANADTPEDAQKAREFGAKGIGLCRTEHMFMGPERLPHVQRMILAETKEEREEALSHLLPMQEEDFYGILKAMEGYPVCIRLLDPPLHEFLPSLEELLVETTELRVRGDNPELLAEKEALLKKVKSLHEFNPMLGHRGCRLGITYPEVYEMQIRAIFNAAARLTKEGYKVYPEVEIPLTIDVNEMKFFKERIDAIAREVMEREGVTFHYTTGTMIELPRAALLADELAEVAEFFSFGTNDLTQTTLGFSRDDAEGKFLTHYLDMKILKENPFIVLDRKGVGKLMKIAVEGGRKTRPDLLVGICGEHGGEPSSVEFCHQIGLDFVSCSPY

SEQ ID NO: 531 - protein, 861 aa, Bacillus coagulans 36D1
TKFVYLFNEGNSHMRDLLGGKGANLAEMTNIGLPVPFGFTITTEACNDYYSNGKKISDAVETQMEEALLKLEEKTGKKLGGNENPLLVSVRSGSVFSMPGMMDTVLNLGMNDETVEAVAKLTGNPRFAYDSYRRFIQMFSDVVLGIEVYHFEHLLEQTREQKGYTADPEMTAEDWKDIIAGYKKIVKKHTKQDFPQDPKTQLYLAVNAVFDSWNNQRAIVYRRLNKIPDHLGTAVNIQSMVFGNMGDDSGTGVAFTRNPSTGERVLYGEYLINAQGEDVVAGIRTPQPIQVLAKDMPEVYRQFVKTSKLLEEHYQDMQDIEFTVERGKLYLLQTRNGKRTAQAAIRIAVEMVKEGILDKKTALLRVDPDQMNQLLHRRIDGSATKNHLAKGLPASPGAATGTVVFDADEAERLGKEGEKVILVRPETTPDDIHGIVASQAVVTSRGGMTSHAAVVARGMGKACICGCESMKIDLKAKQFTVGDTVVRYGDVITIDGSTGEVMLGEVPMIDPELSGEFKTLLEWADEVRDLGVRANADNPTDAKKSLEFGADGIGLCRTEHMFMDIKRVPIVQEMILAETLEEREKALDKLLPMQQGDFEGIFEEMAGHPVTIRLLDPPMHEFLPDKEELLVEVTKLQLTAPESKELEEKEYLLKKVQHLAEFNPMLGHRGCRLGVIFPEIYEMQVKAIFYAAAAVLQKGIKVQPEIMIPLVGHVNELKRMRALVTDMANQVMEEKGLKFDYTVGTMIEIPRAALTADQIAEEADFFSFGTNDLTQTTFGFSRDDAEGKFLQQYIEQKVLPENPFAVLDQEGVGKLVETGVKLGRQTKPGLKTGICGEHGGEKSSIEFCYKTGLNYVSCSPY

SEQ ID NO: 532 - protein, 863 aa, Desulfitobacterium hafniense Y51
MSKKFVYLFREGQASMRDLLGGKGANLAEMTNIGLPVPPGFTITTEACNDYYALGRNLPEGLWEQIGPALGDIEKATGKKFGDKDNPLLVSVRSGAKFSMPGMMDTILNLGLNDETVEGLAASTQNARFAYDSYRRFIQMFGDVVLEVEHHEFERILEEAKEKQNVNYDSELTAESLKGVVEGYKRLIQRRTGSPFPLDPMKQLEQAILAVFRSWNNDRAIVYRRINSIPDNIGTAVNVQSMVFGNMGNDSGTGVAFTRNPSTGERVLYGEYLMNAQGEDVVAGIRTPQPIKSLEDENKAIYAQFVETSNSLEAHYRDMQDIEFTIERGRLYILQTRNGKRTAPAAIRVAVELCREGVISKEEAIARIEPGQLDQLLHRRMDSEAKLEVIAKGLPASPGAASGKIVFDADEAERLGHTGERVLLVRTETTPDDIHGILAAQGILTSRGGMTSHAAVVARHMGKPAVCGCEALRIDYAHNTVTIDGVTYPEGTLFSIDGTTGRVIKGAVPMIDPELSEEFKELLGWADEIRTLKVLANADNPRDAQKARDFGAQGIGLCRTEHMFMDPARIPIVQEMILAQTLPEREVALAKLLPMQEEDFYGILKVMAGFPVTIRLLDPPLHEFLPNVEELVVDITKLKLQGDREEELNEKEVLLRKVRALSEMNPMLGHRGCRLGITFPEIYAMQARAIFQASARLVKEGCEIHPEVMIPLVIHVKELAKLRKVTEEAAQTVMAEQGVTFSYTIGTMIEVPRAALTADEVATAADFFSFGTNDLTQTTLGFSRDDAEGKFLPAYLEQNILEHNPFAVLDRIGVGKLMKMGVQLGREANPGLKVGICGEHGGDPSSIEFCHQIGLNYVSCSPF

SEQ ID NO: 533 - protein, 863 aa, Desulfitobacterium hafniense DCB-2
MSKKFVYLFREGQASMRDLLGGKGANLAEMTNIGLPVPPGFTITTEACNDYYALGRNLPEGLWEQIGPALGDIEKATGKKFGDKDNPLLVSVRSGAKFSMPGMMDTILNLGLNDETVEGLAASTQNARFAYDSYRRFIQMFGDVVLEVEHHEFERILEEAKEKQNVNYDSELTAESLKGVVEGYKRLIQRRTGSPFPLEPMKQLEQAILAVFRSWNNDRAIVYRRINSIPDNIGTAVNVQSMVFGNMGNDSGTGVAFTRNPSTGERVLYGEYLMNAQGEDVVAGIRTPQPIKSLEDENQAIYAQFVKTSNSLEAHYRDMQDIEFTIERGRLYILQTRNGKRTAPAAIRVAVELCREGVISKEEAIARIEPGQLDQLLHRRMDSEAKLEVIAKGLPASPGAASGKIVFDADEAERLGHTGEKVLLVRTETTPDDIHGILAAQGILTSRGGMTSHAAVVARHMGKPAVCGCEALRIDYAHNTVTIDGVTYPEGTLFSIDGTTGRVIKGAVPMIDPELSEEFKELLGWADEIRTLKVLANADNPRDAQKARDFGAQGIGLCRTEHMFMDPARIPIVQEMILAQTLPEREVALAKLLPMQEEDFYGILKVMAGFPVTIRLLDPPLHEFLPNVEELVVDITKLKLQGDREEELNEKEVLLRKVRALSEMNPMLGHRGCRLGITFPEIYAMQARAIFQAAARLVKEGYEIYPEVMIPLVIHVKELAKLRKVTEEAAQTVMAEQGVTFAYTIGTMIEVPRAALTADEVATAADFFSFGTNDLTQTTLGFSRDDAEGKFLPAYLEQNILEHNPFAVLDRIGVGKLMKMGVQLGREANPGLKVGICGEHGGDPSSIEFCHQIGLNYVSCSPF

SEQ ID NO: 534 - protein, 860 aa, Moorella thermoacetica ATCC 39073
KYVYLFSEGKADMRLLLGGKGANLAEMTNIGLPVPQGITITCEACNEYNRLGQQFPEGLEEEVAARLKDLEAINGKKLGDPENPLLVSVRSGAPVSMPGMMDTILNLGLNDNSVKGLAAQTGDERFALDCYRRFIQMFGNVVLGIEHNDFEAVLEKHKERLGVKFDHELTPDALREVIAEYKDVVKSRSGRDFPQDPREQLYMAIRAVFDSWNNPRAIVYRKINKIPDDLGTAVNVQTMAFGNMGPTSGTGVAFTRNPSTGEKGIYGEYLINAQGEDVVAGIRTPKPISSLKEEMPEVYRQFEDICQLLEKHYRDMQDIEFTIEKGKLFILQTRNGKRTAAAAVKIAVDMVNEGLITKEEAVLRVDADQLIQLMHRRIDPSAKLEVVAKGLPASPGAASGQVVFDADDAEKMGLDGQKVVLVRTETTPDDIHGIVQAQGVLTARGGMTSHAAVVARGMGKPAVTGCDAIKIDVENKRFFIGDLVVKEGDVISIDGSTGNVMLGEVPLIDPQLTGEFETILEWADSFRRLKVRANADTPEDARRSREFGADGIGLTRTEHMFMQVDRLPVVQQMILAKTKEERQAALDKLLPMQQGDFYGILKAMEGLPVTIRLLDPPLHEFLPNIEELLVDVTRLQATNGDSKELEEKQALLREVRARHEFNPMLGHRGCRLGITYPEIYAMQVRAIFQAVAQLVKEGVKVLPEVEIPLVIHVNELQRLHAMVDEVAAAVKKETGVDFDYKVGTMIEMPRACATADEIAREAEFFSFGTNDLTQTTFGFSRDDAEGKFLHQYVDEKILKEDPFIVLDRDGVGKFMKMAVELGRSTNPKLEIGICGEHGGEPSSVEFCHQIGLNYVSCSPF

SEQ ID NO: 535 - protein, 927 aa, Artificial
  Substituion in SEQ ID NO 528
MSHGELAASARRPMCKRFAGWATRRPRQGGCKMAQVQDVQRDQALTTRWVYSFDQADPKNRSLLGGKGANLAQMVQWGFPVPPGFTITTEACNEYWARGGKFPEGLLDEVALAILRLERTAGKRFGDAFQPLLVSVRSGAPVSMPGMMDTILNLGLNDLTVRALANQSQDPAFAYDSYRRLIQMFANVVFNVSLEPFEHALRAAKAKHGVERDRDLPADAWKDLVATYLKLFAEHVGQPFPQDVNVQLELAIEAVFRSWNSPRAIVYRKAHGIPETLGTAVNVQAMVFGNMGDDSGTGVIFTRHPSTGEPVLFGEFLANAQGEDVVAGIRTPQPIADLAHTMPHVYESLVALAKQLETRFRDMQDVEFTVERGKLFVLQTRSGKRTAQAAVRIAIDMLHEGLIQPEEALLRVDAQHLRQLLHRRLQGTDALQVFAKGLPASPGASVGRIVLDADTAVEWAQRGEKVVLVRPETTPEDIHGVLAAEGVVTTHGGMTSHAAVVARGIGKPAVCGCDGVHIDFEARQVESNGVVLKEGDVISVDGGTGTVYVGEAQMEEAKMADELKELLSIADQVRRLKVRANADTPEDARRAREFGAEGIGLCRTEHMFLSPDRVPLVQRMILATTSAERQAALSKLLPLQVSDFTAIFEAMDGLPVTIRLLDPPLHEFLPREEELAERLEELRAQGASEDEIAETEQLLRQARYLREANPMMGLRGSRLGIVYPEIYDMQMEAIITAAAQAKRRGIAVDLEVMLPLIGSPKELRVLRERMEEIAKRTMEREGVEIEYRIGTMIEVPRAALTADQIAEDAQFFSFGTNDLTQMTFAFSRDDAEGKFLNVYLDREILPYNPFETLDTEGVGKLIQWAVEAGRKRRPDLKTGVCGEHGGDPASIAFCEDIGLDYVSCSPFRIPVARIAAAQAAVRRRMTG

SEQ ID NO: 536 - protein, 927 aa, Artificial
  Substituion in SEQ ID NO 528
MSHGELAASARRPMCKRFAGWATRRPRQGGCKMAQVQDVQRDQALTTRWVYSFDQADPKNRSLLGGKGANLAQMVQWGFPVPPGFTITTEACNEYWARGGKFPEGLLDEVALAILRLERTAGKRFGDAFQPLLVSVRSGAPVSMPGMMDTILNLGLNDLTVRALANQSQDPAFAYDSYRRLIQMFANVVFNVSLEPFEHALRAAKAKHGVERDRDLPADAWKDLVATYLKLFAEHVGQPFPQDVNVQLELAIEAVFRSWNSPRAIVYRKAHGIPETLGTAVNVQAMVFGNMGDDSGTGVIFTRHPSTGEPVLFGEFLANAQGEDVVAGIRTPQPIADLAHTMPHVYESLVAIAKQLETRFRDMQDVEFTVERGKLFVLQTRSGKRTAQAAVRIAIDMLHEGLIQPEEALLRVDAQHLRQLLHRRLQGTDALQVFAKGLPASPGASVGRIVLDADTAVEWAQRGEKVVLVRPETTPEDIHGVLAAEGVVTTHGGMTSHAAVVARGIGKPAVCGCDGVHIDFEARQVESNGVVLKEGDVISVDGGTGTVYVGEAQMEEAKMADELKELLSIADQVRRLKVRANADTPEDARRAREFGAEGIGLCRTEHMFLSPDRVPLVQRMILATTSAERQAALSKLLPLQVSDFTAIFEAMDGLPVTIRLLDPPLHEFLPREEELAERLEELRAQGASEDEIAETEQLLRQARYLREANPMMGLRGSRLGIVYPEIYDMQMEAIITAAAQAKRRGIAVDLEVMLPLIGSPKELRVLRERMEEIAKRTMEREGVEIEYRIGTMIEVPRAALTADQIAEDAQFFSFGTNDLTQMTFAFSRDDAEGKFLNVYLDREILPYNPFETLDTEGVGKLIQWAVEAGRKRRPDLKTGVCGEHGGDPASIAFCEDIGLDYVSCSPFRIPVARIAAAQAAVRKRMTG

SEQ ID NO: 537 - protein, 927 aa, Artificial
  Substituion in SEQ ID NO 528
MSHGELAASARRPMCKRFAGWATRRPRQGGCKMAQVQDVQRDQALTTRWVYSFDQADPKNRSLLGGKGANLAQMVQWGFPVPPGFTITTEACNEYWARGGKFPEGLLDEVALAILRLERTAGKRFGDAFQPLLVSVRSGAPVSMPGMMDTILNLGLNDLTVRALANQSQDPAFAYDSYRRLIQMFANVVFNVSLEPFEHALRAAKAKHGVERDRDLPADAWKDLVATYLKLFAEHVGQPFPQDVNVQLELAIEAVFRSWNSPRAIVYRKAHGIPETLGTAVNVQAMVFGNMGDDSGTGVIFTRHPSTGEPVLFGEFLANAQGEDVVAGIRTPQPIADLAHTMPHVYESLVALAKQLETRFRDMQDVEFTVERGKLFVLQTRSGKRTAQAAVRIAIDMLHEGLIQPEEALLKVDAQHLRQLLHRRLQGTDALQVFAKGLPASPGASVGRIVLDADTAVEWAQRGEKVVLVRPETTPEDIHGVLAAEGVVTTHGGMTSHAAVVARGIGKPAVCGCDGVHIDFEARQVESNGVVLKEGDVISVDGGTGTVYVGEAQMEEAKMADELKELLSIADQVRRLKVRANADTPEDARRAREFGAEGIGLCRTEHMFLSPDRVPLVQRMILATTSAERQAALSKLLPLQVSDFTAIFEAMDGLPVTIRLLDPPLHEFLPREEELAERLEELRAQGASEDEIAETEQLLRQARYLREANPMMGLRGSRLGIVYPEIYDMQMEAIITAAAQAKRRGIAVDLEVMLPLIGSPKELRVLRERMEEIAKRTMEREGVEIEYRIGTMIEVPRAALTADQIAEDAQFFSFGTNDLTQMTFAFSRDDAEGKFLNVYLDREILPYNPFETLDTEGVGKLIQWAVEAGRKRRPDLKTGVCGEHGGDPASIAFCEDIGLDYVSCSPFRIPVARIAAAQAAVRKRMTG

SEQ ID NO: 538 - protein, 927 aa, Artificial
  Substituion in SEQ ID NO 528
MSHGELAASARRPMCKRFAGWATRRPRQGGCKMAQVQDVQRDQALTTRWVYSFDQADPKNRSLLGGKGANLAQMVQWGFPVPPGFTITTEACNEYWARGGKFPEGLLDEVALAILRLERTAGKRFGDAFQPLLVSVRSGAPVSMPGMMDTILNLGLNDLTVRALANQSQDPAFAYDSYRRLIQMFANVVFNVSLEPFEHALRAAKAKHGVERDRDLPADAWKDLVATYLKLFAEHVGQPFPQDVNVQLELAIEAVFRSWNSPRAIVYRKAHGIPETLGTAVNVQAMVFGNMGDDSGTGVIFTRHPSTGEPVLFGEFLANAQGEDVVAGIRTPQPIADLAHTMPHVYESLVALAKQLETRFRDMQDVEFTVERGKLFVLQTRSGKRTAQAAVRIAIDMLHEGLIQPEEALLRVDAQHLRQLLHRRLQGTDALQVFAKGLPASPGASVGRIVLDADTAVEWAQRGEKVVLVRPETTPEDIHGVLAAEGVVTTHGGMTSHAAVVARGIGKPAVCGCDGVHIDFEARQVESNGVVLKEGDVISVDGGTGTVYVGEAQMEEAKMADELKELLSIADQVRRLKVRANADTPEDARRAREFGAEGIGLCRTEHMFLSPDRVPLVQRMILATTSAERQAALSKLLPLQVSDFTAIFEAMDGLPVTIRLLDPPLHEFLPREEELAERLEELRAQGASEDEIAETEQLLRQARYLREANPMMGLRGSRLGIVYPEIYDMQMEAIITAAAQAKRRGIAVDLEVMLPLIGSPKELRVLRERMEELAKRTMEREGVEIEYRIGTMIEVPRAALTADQIAEDAQFFSFGTNDLTQMTFAFSRDDAEGKFLNVYLDREILPYNPFETLDTEGVGKLIQWAVEAGRKRRPDLKTGVCGEHGGDPASIAFCEDIGLDYVSCSPFRIPVARIAAAQAAVRKRMTG

SEQ ID NO: 539 - protein, 927 aa, Artificial
  Substituion in SEQ ID NO 528
MSHGELAASARRPMCKRFAGWATRRPRQGGCKMAQVQDVQRDQALTTRWVYSFDQADPKNRSLLGGKGANLAQMVQWGFPVPPGFTITTEACNEYWARGGKFPEGLLDEVALAILRLERTAGKRFGDAFQPLLVSVRSGAPVSMPGMMDTILNLGLNDLTVRALANQSQDPAFAYDSYRRLIQMFANVVFNVSLEPFEHALRAAKAKHGVERDRDLPADAWKDLVATYLKLFAEHVGQPFPQDVNVQLELAIEAVFRSWNSPRAIVYRKAHGIPETLGTAVNVQAMVFGNMGDDSGTGVIFTRHPSTGEPVLFGEFLANAQGEDVVAGIRTPQPIADLAHTMPHVYESLVALAKQLETRFRDMQDVEFTVERGKLFVLQTRSGKRTAQAAVRIAIDMLHEGLIQPEEALLRVDAQHLRQLLHRRLQGTDALQVFAKGLPASPGASVGRIVLDADTAVEWAQRGEKVVLVRPETTPEDIHGVLAAEGVVTTHGGMTSHAAVVARGIGKPAVCGCDGVHIDFEARQVESNGVVLKEGDVISVDGGTGTVYVGEAQMEEAKMADELKELLSIADQVRRLKVRANADTPEDARRAREFGAEGIGLCRTEHMFLSPDRVPLVQRMILATTSAERQAALSKLLPLQVSDFTAIFEAMDGLPVTIRLLDPPLHEFLPREEELAERLEELRANGASEDEIAETEQLLRQARYLREANPMMGLRGSRLGIVYPEIYDMQMEAIITAAAQAKRRGIAVDLEVMLPLIGSPKELRVLRERMEEIAKRTMEREGVEIEYRIGTMIEVPRAALTADQIAEDAQFFSFGTNDLTQMTFAFSRDDAEGKFLNVYLDREILPYNPFETLDTEGVGKLIQWAVEAGRKRRPDLKTGVCGEHGGDPASIAFCEDIGLDYVSCSPFRIPVARIAAAQAAVRKRMTG

SEQ ID NO: 540 - DNA, 2784 bp, Artificial
  Substituion in SEQ ID NO 529
gtgtcacatggcgagctcgcggcaagcgcacggcgacccatgtgcaagcgcttcgccggatgggcgacacgaaggccgcgacaagggggatgcaagatggcgcaggtgcaggatgtacagcgcgatcaggcgctcacgacccggtgggtctattcctttgatcaagcagatccgaaaaaccgaagccttttgggcggcaaaggcgccaacttggcgcagatggttcaatgggggtttcccgtcccgcctggctttaccatcacgacggaggcttgcaacgaatattgggcgcggggcggcaagtttcccgaagggctgctggacgaggtggcgctcgccatcctgcggctcgagcgcacggccgggaagcgattcggcgacgcgtttcagccgctccttgtttccgtgcgctccggcgcgcccgtgtcgatgccgggcatgatggacaccattttgaatctgggcctcaatgatctgacggtgcgggcgctggcgaatcagtcgcaggatcccgcgttcgcctacgactcgtaccgccgcctgattcaaatgttcgcaaacgtggtgttcaacgtatcgctggagccgttcgaacacgcgcttagggcggcgaaggccaagcacggcgttgagcgcgatcgcgaccttccggccgacgcgtggaaggatctcgtggcgacgtacctgaaactgtttgcagaacacgtcggacagccgttcccgcaggacgtgaacgtgcaattggaactcgccatcgaggccgtgttccgctcgtggaacagcccgcgggccatcgtctatcgcaaggctcacggtatccctgagaccctcggcacagcggtcaacgttcaggccatggtgtttggcaacatgggcgacgacagcggcacgggcgtgatcttcacgcgccatccgtcgacgggcgagcccgtcttgttcggcgagttcttggccaacgctcagggcgaggacgtggtcgcgggcattcgcacgcctcaacccattgccgatctcgcccacaccatgccgcacgtgtacgagtcgcttgtggccctcgcgaaacagttggagacgcgcttccgggacatgcaggacgtcgagttcacggtggagcggggcaagctgttcgtgctgcagacgcggagcgggaagcgcacggcgcaggcggccgtccgcatcgccatcgacatgctgcatgaaggcctgattcagccggaagaggcgctcctgcgcgtcgacgcccagcatctgcgccagcttttgcaccggcggctgcagggaacggatgcactgcaggtgttcgccaaggggcttccggcgtctccaggcgcgagcgtgggccgaattgtgttggatgcggacacggcggtggagtgggcgcagcgcggcgagaaggtcgtcctcgtgaggcctgagacgacgcccgaggacatccacggcgtgctggccgcggaaggcgttgtgacgacgcacggtgggatgacgagccacgcggcggttgtggcccgcggaattggcaagccggcggtctgcggctgtgacggcgtgcacatcgacttcgaggcgcgtcaggtcgaatcgaacggcgtcgtgctgaaggaaggtgacgtcatctcggtggacggcggaaccgggacggtgtatgtcggagaggcgcagatggaagaagcgaaaatggcggacgagctgaaggagttgctgtccatcgcggaccaagtgcggcgcctcaaggtccgcgccaacgcggacacgccggaagacgcgcggcgcgcgcgagagttcggcgctgagggcattggcctgtgccgcacggaacacatgttcctgtcgccggatcgggtgccgctcgtgcagcgcatgattttggcgaccacgtcggctgagcgacaggcggccctgtcgaaactgctgccgctccaggtctcggatttcaccgccatcttcgaagcgatggacggcctgccggtgaccatacgtctgctggatccgccgctgcacgagttcctgccgcgcgaagaggagctggccgaacgcctcgaggagcttcgcgcgcagggcgcgtccgaggacgagatcgccgagacggaacagttgctccggcaagcccgatacctgcgggaggccaaccccatgatgggtctccgaggttctcggttgggcatcgtgtaccctgagatctacgatatgcagatggaggccatcatcacggccgcggcgcaggcgaaacgccgaggcatcgccgtcgacctggaagtgatgttgccgctcatcggctctccgaaggaacttcgcgttttgcgcgagcgcatggaggagatcgctaagcggacgatggagcgcgagggcgtcgagatcgaataccgcatcggcacgatgatcgaggtgccgcgcgccgcgctgacggcggaccagattgcggaggatgcgcagttcttctccttcggcaccaacgacctgacgcagatgacgttcgccttcagccgagacgacgccgaggggaaattcctcaacgtatacctggatcgggagatcttgccttacaacccgttcgagacgctggatacggagggcgtcggcaagctgattcaatgggcagtcgaagcggggcgcaagcgccgtcccgatttgaagaccggcgtgtgcggcgaacacgggggcgatccggcgtcgattgcgttctgcgaggacattgggctcgactacgtcagctgctcgcccttccgcatcccggtcgcgcggattgccgcggcgcaggcggccgtgcgccgtcgcatgacgggttga

SEQ ID NO: 541 - DNA, 2784 bp, Artificial
  Substituion in SEQ ID NO 529
gtgtcacatggcgagctcgcggcaagcgcacggcgacccatgtgcaagcgcttcgccggatgggcgacacgaaggccgcgacaagggggatgcaagatggcgcaggtgcaggatgtacagcgcgatcaggcgctcacgacccggtgggtctattcctttgatcaagcagatccgaaaaaccgaagccttttgggcggcaaaggcgccaacttggcgcagatggttcaatgggggtttcccgtcccgcctggctttaccatcacgacggaggcttgcaacgaatattgggcgcggggcggcaagtttcccgaagggctgctggacgaggtggcgctcgccatcctgcggctcgagcgcacggccgggaagcgattcggcgacgcgtttcagccgctccttgtttccgtgcgctccggcgcgcccgtgtcgatgccgggcatgatggacaccattttgaatctgggcctcaatgatctgacggtgcgggcgctggcgaatcagtcgcaggatcccgcgttcgcctacgactcgtaccgccgcctgattcaaatgttcgcaaacgtggtgttcaacgtatcgctggagccgttcgaacacgcgcttagggcggcgaaggccaagcacggcgttgagcgcgatcgcgaccttccggccgacgcgtggaaggatctcgtggcgacgtacctgaaactgtttgcagaacacgtcggacagccgttcccgcaggacgtgaacgtgcaattggaactcgccatcgaggccgtgttccgctcgtggaacagcccgcgggccatcgtctatcgcaaggctcacggtatccctgagaccctcggcacagcggtcaacgttcaggccatggtgtttggcaacatgggcgacgacagcggcacgggcgtgatcttcacgcgccatccgtcgacgggcgagcccgtcttgttcggcgagttcttggccaacgctcagggcgaggacgtggtcgcgggcattcgcacgcctcaacccattgccgatctcgcccacaccatgccgcacgtgtacgagtcgcttgtggccattgcgaaacagttggagacgcgcttccgggacatgcaggacgtcgagttcacggtggagcggggcaagctgttcgtgctgcagacgcggagcgggaagcgcacggcgcaggcggccgtccgcatcgccatcgacatgctgcatgaaggcctgattcagccggaagaggcgctcctgcgcgtcgacgcccagcatctgcgccagcttttgcaccggcggctgcagggaacggatgcactgcaggtgttcgccaaggggcttccggcgtctccaggcgcgagcgtgggccgaattgtgttggatgcggacacggcggtggagtgggcgcagcgcggcgagaaggtcgtcctcgtgaggcctgagacgacgcccgaggacatccacggcgtgctggccgcggaaggcgttgtgacgacgcacggtgggatgacgagccacgcggcggttgtggcccgcggaattggcaagccggcggtctgcggctgtgacggcgtgcacatcgacttcgaggcgcgtcaggtcgaatcgaacggcgtcgtgctgaaggaaggtgacgtcatctcggtggacggcggaaccgggacggtgtatgtcggagaggcgcagatggaagaagcgaaaatggcggacgagctgaaggagttgctgtccatcgcggaccaagtgcggcgcctcaaggtccgcgccaacgcggacacgccggaagacgcgcggcgcgcgcgagagttcggcgctgagggcattggcctgtgccgcacggaacacatgttcctgtcgccggatcgggtgccgctcgtgcagcgcatgattttggcgaccacgtcggctgagcgacaggcggccctgtcgaaactgctgccgctccaggtctcggatttcaccgccatcttcgaagcgatggacggcctgccggtgaccatacgtctgctggatccgccgctgcacgagttcctgccgcgcgaagaggagctggccgaacgcctcgaggagcttcgcgcgcagggcgcgtccgaggacgagatcgccgagacggaacagttgctccggcaagcccgatacctgcgggaggccaaccccatgatgggtctccgaggttctcggttgggcatcgtgtaccctgagatctacgatatgcagatggaggccatcatcacggccgcggcgcaggcgaaacgccgaggcatcgccgtcgacctggaagtgatgttgccgctcatcggctctccgaaggaacttcgcgttttgcgcgagcgcatggaggagatcgctaagcggacgatggagcgcgagggcgtcgagatcgaataccgcatcggcacgatgatcgaggtgccgcgcgccgcgctgacggcggaccagattgcggaggatgcgcagttcttctccttcggcaccaacgacctgacgcagatgacgttcgccttcagccgagacgacgccgaggggaaattcctcaacgtatacctggatcgggagatcttgccttacaacccgttcgagacgctggatacggagggcgtcggcaagctgattcaatgggcagtcgaagcggggcgcaagcgccgtcccgatttgaagaccggcgtgtgcggcgaacacgggggcgatccggcgtcgattgcgttctgcgaggacattgggctcgactacgtcagctgctcgcccttccgcatcccggtcgcgcggattgccgcggcgcaggcggccgtgcgcaaacgcatgacgggttga

SEQ ID NO: 542 - DNA, 2784 bp, Artificial
  Substituion in SEQ ID NO 529
gtgtcacatggcgagctcgcggcaagcgcacggcgacccatgtgcaagcgcttcgccggatgggcgacacgaaggccgcgacaagggggatgcaagatggcgcaggtgcaggatgtacagcgcgatcaggcgctcacgacccggtgggtctattcctttgatcaagcagatccgaaaaaccgaagccttttgggcggcaaaggcgccaacttggcgcagatggttcaatgggggtttcccgtcccgcctggctttaccatcacgacggaggcttgcaacgaatattgggcgcggggcggcaagtttcccgaagggctgctggacgaggtggcgctcgccatcctgcggctcgagcgcacggccgggaagcgattcggcgacgcgtttcagccgctccttgtttccgtgcgctccggcgcgcccgtgtcgatgccgggcatgatggacaccattttgaatctgggcctcaatgatctgacggtgcgggcgctggcgaatcagtcgcaggatcccgcgttcgcctacgactcgtaccgccgcctgattcaaatgttcgcaaacgtggtgttcaacgtatcgctggagccgttcgaacacgcgcttagggcggcgaaggccaagcacggcgttgagcgcgatcgcgaccttccggccgacgcgtggaaggatctcgtggcgacgtacctgaaactgtttgcagaacacgtcggacagccgttcccgcaggacgtgaacgtgcaattggaactcgccatcgaggccgtgttccgctcgtggaacagcccgcgggccatcgtctatcgcaaggctcacggtatccctgagaccctcggcacagcggtcaacgttcaggccatggtgtttggcaacatgggcgacgacagcggcacgggcgtgatcttcacgcgccatccgtcgacgggcgagcccgtcttgttcggcgagttcttggccaacgctcagggcgaggacgtggtcgcgggcattcgcacgcctcaacccattgccgatctcgcccacaccatgccgcacgtgtacgagtcgcttgtggccctcgcgaaacagttggagacgcgcttccgggacatgcaggacgtcgagttcacggtggagcggggcaagctgttcgtgctgcagacgcggagcgggaagcgcacggcgcaggcggccgtccgcatcgccatcgacatgctgcatgaaggcctgattcagccggaagaggcgctcctgaaagtcgacgcccagcatctgcgccagcttttgcaccggcggctgcagggaacggatgcactgcaggtgttcgccaaggggcttccggcgtctccaggcgcgagcgtgggccgaattgtgttggatgcggacacggcggtggagtgggcgcagcgcggcgagaaggtcgtcctcgtgaggcctgagacgacgcccgaggacatccacggcgtgctggccgcggaaggcgttgtgacgacgcacggtgggatgacgagccacgcggcggttgtggcccgcggaattggcaagccggcggtctgcggctgtgacggcgtgcacatcgacttcgaggcgcgtcaggtcgaatcgaacggcgtcgtgctgaaggaaggtgacgtcatctcggtggacggcggaaccgggacggtgtatgtcggagaggcgcagatggaagaagcgaaaatggcggacgagctgaaggagttgctgtccatcgcggaccaagtgcggcgcctcaaggtccgcgccaacgcggacacgccggaagacgcgcggcgcgcgcgagagttcggcgctgagggcattggcctgtgccgcacggaacacatgttcctgtcgccggatcgggtgccgctcgtgcagcgcatgattttggcgaccacgtcggctgagcgacaggcggccctgtcgaaactgctgccgctccaggtctcggatttcaccgccatcttcgaagcgatggacggcctgccggtgaccatacgtctgctggatccgccgctgcacgagttcctgccgcgcgaagaggagctggccgaacgcctcgaggagcttcgcgcgcagggcgcgtccgaggacgagatcgccgagacggaacagttgctccggcaagcccgatacctgcgggaggccaaccccatgatgggtctccgaggttctcggttgggcatcgtgtaccctgagatctacgatatgcagatggaggccatcatcacggccgcggcgcaggcgaaacgccgaggcatcgccgtcgacctggaagtgatgttgccgctcatcggctctccgaaggaacttcgcgttttgcgcgagcgcatggaggagatcgctaagcggacgatggagcgcgagggcgtcgagatcgaataccgcatcggcacgatgatcgaggtgccgcgcgccgcgctgacggcggaccagattgcggaggatgcgcagttcttctccttcggcaccaacgacctgacgcagatgacgttcgccttcagccgagacgacgccgaggggaaattcctcaacgtatacctggatcgggagatcttgccttacaacccgttcgagacgctggatacggagggcgtcggcaagctgattcaatgggcagtcgaagcggggcgcaagcgccgtcccgatttgaagaccggcgtgtgcggcgaacacgggggcgatccggcgtcgattgcgttctgcgaggacattgggctcgactacgtcagctgctcgcccttccgcatcccggtcgcgcggattgccgcggcgcaggcggccgtgcgcaaacgcatgacgggttga

SEQ ID NO: 543 - DNA, 2784 bp, Artificial
  Substituion in SEQ ID NO 529
gtgtcacatggcgagctcgcggcaagcgcacggcgacccatgtgcaagcgcttcgccggatgggcgacacgaaggccgcgacaagggggatgcaagatggcgcaggtgcaggatgtacagcgcgatcaggcgctcacgacccggtgggtctattcctttgatcaagcagatccgaaaaaccgaagccttttgggcggcaaaggcgccaacttggcgcagatggttcaatgggggtttcccgtcccgcctggctttaccatcacgacggaggcttgcaacgaatattgggcgcggggcggcaagtttcccgaagggctgctggacgaggtggcgctcgccatcctgcggctcgagcgcacggccgggaagcgattcggcgacgcgtttcagccgctccttgtttccgtgcgctccggcgcgcccgtgtcgatgccgggcatgatggacaccattttgaatctgggcctcaatgatctgacggtgcgggcgctggcgaatcagtcgcaggatcccgcgttcgcctacgactcgtaccgccgcctgattcaaatgttcgcaaacgtggtgttcaacgtatcgctggagccgttcgaacacgcgcttagggcggcgaaggccaagcacggcgttgagcgcgatcgcgaccttccggccgacgcgtggaaggatctcgtggcgacgtacctgaaactgtttgcagaacacgtcggacagccgttcccgcaggacgtgaacgtgcaattggaactcgccatcgaggccgtgttccgctcgtggaacagcccgcgggccatcgtctatcgcaaggctcacggtatccctgagaccctcggcacagcggtcaacgttcaggccatggtgtttggcaacatgggcgacgacagcggcacgggcgtgatcttcacgcgccatccgtcgacgggcgagcccgtcttgttcggcgagttcttggccaacgctcagggcgaggacgtggtcgcgggcattcgcacgcctcaacccattgccgatctcgcccacaccatgccgcacgtgtacgagtcgcttgtggccctcgcgaaacagttggagacgcgcttccgggacatgcaggacgtcgagttcacggtggagcggggcaagctgttcgtgctgcagacgcggagcgggaagcgcacggcgcaggcggccgtccgcatcgccatcgacatgctgcatgaaggcctgattcagccggaagaggcgctcctgcgcgtcgacgcccagcatctgcgccagcttttgcaccggcggctgcagggaacggatgcactgcaggtgttcgccaaggggcttccggcgtctccaggcgcgagcgtgggccgaattgtgttggatgcggacacggcggtggagtgggcgcagcgcggcgagaaggtcgtcctcgtgaggcctgagacgacgcccgaggacatccacggcgtgctggccgcggaaggcgttgtgacgacgcacggtgggatgacgagccacgcggcggttgtggcccgcggaattggcaagccggcggtctgcggctgtgacggcgtgcacatcgacttcgaggcgcgtcaggtcgaatcgaacggcgtcgtgctgaaggaaggtgacgtcatctcggtggacggcggaaccgggacggtgtatgtcggagaggcgcagatggaagaagcgaaaatggcggacgagctgaaggagttgctgtccatcgcggaccaagtgcggcgcctcaaggtccgcgccaacgcggacacgccggaagacgcgcggcgcgcgcgagagttcggcgctgagggcattggcctgtgccgcacggaacacatgttcctgtcgccggatcgggtgccgctcgtgcagcgcatgattttggcgaccacgtcggctgagcgacaggcggccctgtcgaaactgctgccgctccaggtctcggatttcaccgccatcttcgaagcgatggacggcctgccggtgaccatacgtctgctggatccgccgctgcacgagttcctgccgcgcgaagaggagctggccgaacgcctcgaggagcttcgcgcgcagggcgcgtccgaggacgagatcgccgagacggaacagttgctccggcaagcccgatacctgcgggaggccaaccccatgatgggtctccgaggttctcggttgggcatcgtgtaccctgagatctacgatatgcagatggaggccatcatcacggccgcggcgcaggcgaaacgccgaggcatcgccgtcgacctggaagtgatgttgccgctcatcggctctccgaaggaacttcgcgttttgcgcgagcgcatggaggagttagctaagcggacgatggagcgcgagggcgtcgagatcgaataccgcatcggcacgatgatcgaggtgccgcgcgccgcgctgacggcggaccagattgcggaggatgcgcagttcttctccttcggcaccaacgacctgacgcagatgacgttcgccttcagccgagacgacgccgaggggaaattcctcaacgtatacctggatcgggagatcttgccttacaacccgttcgagacgctggatacggagggcgtcggcaagctgattcaatgggcagtcgaagcggggcgcaagcgccgtcccgatttgaagaccggcgtgtgcggcgaacacgggggcgatccggcgtcgattgcgttctgcgaggacattgggctcgactacgtcagctgctcgcccttccgcatcccggtcgcgcggattgccgcggcgcaggcggccgtgcgcaaacgcatgacgggttga

SEQ ID NO: 544 - DNA, 2784 bp, Artificial
  Substituion in SEQ ID NO 529
gtgtcacatggcgagctcgcggcaagcgcacggcgacccatgtgcaagcgcttcgccggatgggcgacacgaaggccgcgacaagggggatgcaagatggcgcaggtgcaggatgtacagcgcgatcaggcgctcacgacccggtgggtctattcctttgatcaagcagatccgaaaaaccgaagccttttgggcggcaaaggcgccaacttggcgcagatggttcaatgggggtttcccgtcccgcctggctttaccatcacgacggaggcttgcaacgaatattgggcgcggggcggcaagtttcccgaagggctgctggacgaggtggcgctcgccatcctgcggctcgagcgcacggccgggaagcgattcggcgacgcgtttcagccgctccttgtttccgtgcgctccggcgcgcccgtgtcgatgccgggcatgatggacaccattttgaatctgggcctcaatgatctgacggtgcgggcgctggcgaatcagtcgcaggatcccgcgttcgcctacgactcgtaccgccgcctgattcaaatgttcgcaaacgtggtgttcaacgtatcgctggagccgttcgaacacgcgcttagggcggcgaaggccaagcacggcgttgagcgcgatcgcgaccttccggccgacgcgtggaaggatctcgtggcgacgtacctgaaactgtttgcagaacacgtcggacagccgttcccgcaggacgtgaacgtgcaattggaactcgccatcgaggccgtgttccgctcgtggaacagcccgcgggccatcgtctatcgcaaggctcacggtatccctgagaccctcggcacagcggtcaacgttcaggccatggtgtttggcaacatgggcgacgacagcggcacgggcgtgatcttcacgcgccatccgtcgacgggcgagcccgtcttgttcggcgagttcttggccaacgctcagggcgaggacgtggtcgcgggcattcgcacgcctcaacccattgccgatctcgcccacaccatgccgcacgtgtacgagtcgcttgtggccctcgcgaaacagttggagacgcgcttccgggacatgcaggacgtcgagttcacggtggagcggggcaagctgttcgtgctgcagacgcggagcgggaagcgcacggcgcaggcggccgtccgcatcgccatcgacatgctgcatgaaggcctgattcagccggaagaggcgctcctgcgcgtcgacgcccagcatctgcgccagcttttgcaccggcggctgcagggaacggatgcactgcaggtgttcgccaaggggcttccggcgtctccaggcgcgagcgtgggccgaattgtgttggatgcggacacggcggtggagtgggcgcagcgcggcgagaaggtcgtcctcgtgaggcctgagacgacgcccgaggacatccacggcgtgctggccgcggaaggcgttgtgacgacgcacggtgggatgacgagccacgcggcggttgtggcccgcggaattggcaagccggcggtctgcggctgtgacggcgtgcacatcgacttcgaggcgcgtcaggtcgaatcgaacggcgtcgtgctgaaggaaggtgacgtcatctcggtggacggcggaaccgggacggtgtatgtcggagaggcgcagatggaagaagcgaaaatggcggacgagctgaaggagttgctgtccatcgcggaccaagtgcggcgcctcaaggtccgcgccaacgcggacacgccggaagacgcgcggcgcgcgcgagagttcggcgctgagggcattggcctgtgccgcacggaacacatgttcctgtcgccggatcgggtgccgctcgtgcagcgcatgattttggcgaccacgtcggctgagcgacaggcggccctgtcgaaactgctgccgctccaggtctcggatttcaccgccatcttcgaagcgatggacggcctgccggtgaccatacgtctgctggatccgccgctgcacgagttcctgccgcgcgaagaggagctggccgaacgcctcgaggagcttcgcgcgaatggcgcgtccgaggacgagatcgccgagacggaacagttgctccggcaagcccgatacctgcgggaggccaaccccatgatgggtctccgaggttctcggttgggcatcgtgtaccctgagatctacgatatgcagatggaggccatcatcacggccgcggcgcaggcgaaacgccgaggcatcgccgtcgacctggaagtgatgttgccgctcatcggctctccgaaggaacttcgcgttttgcgcgagcgcatggaggagatcgctaagcggacgatggagcgcgagggcgtcgagatcgaataccgcatcggcacgatgatcgaggtgccgcgcgccgcgctgacggcggaccagattgcggaggatgcgcagttcttctccttcggcaccaacgacctgacgcagatgacgttcgccttcagccgagacgacgccgaggggaaattcctcaacgtatacctggatcgggagatcttgccttacaacccgttcgagacgctggatacggagggcgtcggcaagctgattcaatgggcagtcgaagcggggcgcaagcgccgtcccgatttgaagaccggcgtgtgcggcgaacacgggggcgatccggcgtcgattgcgttctgcgaggacattgggctcgactacgtcagctgctcgcccttccgcatcccggtcgcgcggattgccgcggcgcaggcggccgtgcgcaaacgcatgacgggttga

SEQ ID NO: 545 - protein, 797 aa, Alicyclobacillus acidocaldarius
MRQIRRAAVIGSGVMGAQIAAHLANVGIPSLLLDLVPQELTAEEQKKGLSLDHPAVRNRLATEAIRRLNKLSPAPLFRADYAKLITPGNLEDDLHRICEVDWVIEVIVESLEPKRQLLERIERYWHEGMIVSTNTSGISINAMVEGRSEAFRRHFLGTHFFNPPRYMKLLEVIPGRDTDPAIVEFMRDFGTERLGKGVVLAKDTPNFIANRIGTYGLLVTVEEMQKGGFTVEEVDAITGPALGRPKSATFRTLDLVGIDTFVHVANNVRQNVTDPQEQRAFEVPEAIQKLVERGWLGEKSGQGFYKRVKQNGQRQILVLDLDTFEYREQKKIASSALEASKQAKGAAGKAKALLQGGDRYAELAWNIVKRVLVYSAEKLGEIADTIQDIDAAMRWGFNWELGPFELWDALGLVETAERMRAEGLRLPSWVEDWIAAGHRAFYEEKDGKLTMPVNGKPEPVRVPAGVIDLAALKKAGKVIAQNTGASLIDLGDGVACLEFHSQNNAIGPDILTMIEKSVAIAEKDFAGLVIANQGKNFCVGANLMLILMAAQEGDWDEIDLSIRQFHRAMLALRYSQVPVVAAPHRMTLGGGVEVCLASSRVLPAAETYFGLVEVGVGVIPGGGGCKETARRVAESVGPEDDLVPALARMFQAIGTAKVSTSGAEALAMGWLRETDRVVVNDDLRISAAKAEVLRMAEIGYTAPPKAKEIRVAGRDGKATLQMAARSMWNGGYITDYDLHIAYKLAHVLAGGDVPAGSLVSEDYLLDLEREAFLSLCGEPKTIQRMQHMLATGKPLRN

SEQ ID NO: 546 - DNA, 2394 bp, Alicyclobacillus acidocaldarius
atgagacaaattcgccgagctgccgtcattggttccggcgtgatgggggcgcaaattgccgctcatctcgccaacgtgggcattccgagcctgctgttggacctcgttccgcaagagttgactgcggaagaacaaaagaaaggtttgtcgctcgatcacccagcggttcgcaaccgcctggcgacggaggccatccgtaggctgaacaagctcagcccggcgcccttgttccgcgccgactacgcgaaactcatcacgcctggaaacctcgaggacgacctgcatcggatctgcgaggtcgactgggtgattgaggtcatcgtggagagcctcgagcccaagcgccaactgctcgagcgcatcgagcgatactggcacgagggcatgattgtgagcaccaacacgtcgggcatctccatcaacgcgatggtcgaggggcgaagcgaggcgttccgccgacacttcctcggcacgcacttcttcaatcctccgcgctacatgaagctgttggaggtcattcctggccgggatacggatcccgccatcgtggagttcatgcgcgactttggaacggagcgcctcggcaaaggcgtggtgttggcgaaagacacgccgaacttcatcgccaatcgcatcggcacctacggcctcttggtgaccgtggaggagatgcaaaagggcggcttcaccgttgaggaggtcgacgccatcaccggtccggccctcgggcgcccgaagagcgcgaccttccgcacgctggatctcgtcgggatcgacacgtttgtccacgtggccaacaacgtgcgtcagaacgtgaccgatccacaggaacagcgggcgtttgaggtgccagaggccatccagaagctcgtggagcgcggatggctcggcgagaagagcggacaaggcttttataagcgcgtgaagcaaaacggccagcgccagatcctcgtgctcgatctcgacacgttcgagtaccgcgagcaaaagaagatcgcttcgtcggcgctcgaggcctcgaagcaggccaaaggggcggccggaaaggcgaaggcgctcctccagggcggcgatcggtacgcagaactcgcgtggaacatcgtcaagcgcgtgctcgtgtactcggccgagaaactgggcgagatcgcggacacgattcaggacatcgacgccgcgatgcgctggggattcaactgggagctcgggccgtttgaactctgggacgcgctcgggctggtggagactgccgagcggatgcgcgcggaagggctcaggctgccctcatgggtcgaggactggattgctgcggggcatcgcgccttctacgaagagaaagacggcaagctgaccatgccggtgaacggcaagcctgagcctgttcgggtgccggctggggtgatcgatctcgccgcgctgaagaaggcaggcaaggtcatcgcgcagaacaccggcgcgagcctcatcgacctgggcgacggggtcgcgtgcctggagttccattcgcagaacaacgccattggccccgacattctgacgatgatcgaaaagagcgtggccatcgcggagaaagacttcgcgggcctggtcatcgcgaaccagggcaagaacttctgcgtcggcgcgaacctcatgctcatcctgatggcagcgcaggagggcgactgggacgaaattgatctctccatccgccagttccaccgcgccatgcttgcgcttcgctacagccaagtgccggtggtggcggcgcctcatcggatgacgctcggcggcggcgtcgaagtgtgcctggcgtcgtcgagggtgctgccggccgcggagacctatttcgggttggtcgaggtgggcgtcggcgtcattccgggcggcggcggctgcaaggagacggcgcgccgcgtggcggaatcggtcggccccgaagacgatctcgtccccgctctagcccgcatgttccaggccatcggcaccgccaaggtgtcgacgagtggcgccgaggccctggcgatgggctggctgcgcgagacggatcgcgtggtggtgaacgacgacctgcgcatctcggccgcgaaggcggaggtgcttcgcatggctgagattggctacaccgcgccgccgaaggcgaaggaaattcgcgtcgcgggccgcgacggcaaggcgaccttgcagatggccgcgcgcagcatgtggaacggtggctacatcacggattacgacctccacatcgcctacaagctcgcgcatgtgctggcgggcggcgacgtgccggcgggctccctcgtgagcgaggactacctgctcgatctcgagcgcgaggcgttcctcagcctgtgcggagagccgaagaccatccagcgcatgcagcacatgctcgccaccgggaagccgcttcgcaactga

SEQ ID NO: 547 - protein, 794 aa, Geobacillus kaustophilus HTA426
VKRIRRAAVLGSGVMGSGIAAHLANVGIPTLLLDIVPRELTKEEEAKGWTLEHKQVRNRLANQALERLLKQKPAPLMSKDNIALIETGNFEDDFHRLAEVDWIIEAVVEKLEVKKEVFARVDEVRTPGTIVSSNTSGISIAAMAEGRSDDFKKHFLGTHFFNPPRYLKLLEIIPTEHTDPDVVAYMKSFGEDVLGKGVVMAKDTPNFIANRIGTYGLLVTVREMMQGGYSVGEVDSVTGPLIGRPKSATFRTLDVVGLDTFVHVANNVYENVEGEEKEAFRVPEFMKTMLENGWLGSKSGQGFFVKQGKDILELNYVTMQYEPRKKLVTPAVEMAKQAKGAAAKLQTLVYADGDRAGTLLWNIIAPTLLYTARLVGEIADDIAAIDQAMKWGFGWEQGPFELWDAIGLEKSVRKMQSEGRDIPSWITDMLADGATSFYKTENGRLFYYAPGGYKTVEENEKVIHIRRLKEARGVIKKNAGASLIDLGDDVALLEFHSPNNAIGADIVQMINEALEEVNRNYKGLVIGNQGKNFCVGANLAMMLMEAQDENFFELELAVRQFQQALLKMKYNPKPVVVAPFAMTLGGGAEVSLAASRIQAAAETYIGLVEVGVGLIPGGGGNKELYIKRLNSLPRGVDVDYVKIAASVFETIAMAKVSTSAAEARELGFLNHRDGITMNGDHLLYEAKQAVLSMYEEGYRPPVRKKVPVAGESGYAAMLLGAQSMFHSGYISEHDLKIAKKLAYVLAGGKVPYGTEVDEQYLLDLEREAFLSLIGEPKTQARMQHMLVKGKPLRN

SEQ ID NO: 548 - protein, 790 aa, Symbiobacterium thermophilum IAM 14863
IRKAAVLGAGVMGAQIAAHLANVGIPTLLLDIVPRELTPDEAKKGLTLESPAVRNRLAASALQNLQKLKPSPLYSKDVLRLITPGNLEDDLAKVAECDWVVEAVIENLQIKKDLWQRVAAHHRPGMICSSNTSGISIQAMVEGTPESFRRHFLGTHFFNPPRYMKLLEIIPTPDTDPEVVAFMADFGERVLGKGVVMAKDTPNFIGNRIGVYGMMVTLEEMNRLGLTPDEVDALTGKAIGRPKSATFRTLDVVGIDTFCHVADNCRATIPDPEEAKIFVVPEPIREMVKRGWVGQKARQGFFKKEGDQILTLDLETMEYRPRRKASFPSLEAAKANPDLRSRVRGLVFAKDKAGEFLWAITKRTLLYAARKVGEIADDVVAIDNAMKWGYNWELGPFEMWDAIGLPESIARMEAEGEAVPDWVKEAARKGGFYRREAGKSFFINKGEYAPVPVSDRVIDIGALRETGRVVREKKGATLLDMGDGVLLMETHSPKAAIGFDIINMCKVAAEELASGRWKGLVIGARTENFCVGANVAIMLMEAQEEEWDELEFMAREFQNAFMALKLAPKPVVVAPYGMTLGGGYELCAVADRVVAAAESYIGLVEVGVGVIPGAGGNKEMLIRGLEGLPAGAQVDIQPILNRIFETIATAKVATSAREAQEMGYLRKSDVIVVNKDHQLYEAKRVVLALEAAGYRPPEPALIPAAGPEGRAVLELGAYGMFMGGWATEHELFIARKLAYVLTGGNVPAGTLVTEQYLLDLEREAFLSLLGTKKTQERMAHLLKTGKPLRN

SEQ ID NO: 549 - protein, 791 aa, Bacillus halodurans C-125
RQIRKVAVIGSGVMGSGIAAHLANVGIPSLLLDIVPNQLTEEEQRKGLTLEDRAVRNRLATLALKKLQKQKPAPLSRKSHVHYIQPGNLEDDVEKLAEVDWIIEVVVENLDVKKQLFEKVDQYRKQGTLVSSNTSGISIEAMAKGRSEDFQAHFLGTHFFNPPRYLKLLEIIPTKKTKPEVTAFMKAFAEDVLGKGVVEGKDTPNFIANRIGTYGLLVTVQKMLEGGYSVGEVDSVTGPLIGRPKSATFRTLDVVGLDTFLHVAKNVHDVVDGEEKDVFDPPVFMKKMAENGWIGSKSGQGFFLKQKGENGSEILELNPSTLEYEKRKKMKAPSIEQAKQAKSLNEKLSILIQANDRAGQLLWNLMKPVLIYSAEKVYEIAGDIKAVDDAMKWGFGWEQGPFEMWDAIGVASSVQRMEEEGATVPSWVKEMLTSGRERFYQDGTFYHHGEAKVIPINGKIIHLKALKPERVITKNSGASLIDLGDDVALLEFHSPNNSIGFDVVQMINKAVDEVEANYKGLVIGNQGKNFCVGANLMMILMEAQDDNFFEIDMVVRQFQQAMAKIRYSQKPVVSAPFAMTLGGGTEICLPTASIQASLETYMGLVEVGVGVIPGGGGNKELYLRHLERLPEGANIDLQSIANKTFETIAMAKVSTSAHEAMENGFLSERDGVVVNGDHLLYQAKQQVIHLHDAGYRPPARKKIPVVGETGYATMLLGAKSMKFGGMISEHDLKIAEKLAFVIAGGRVAKGTLVDEQYLLDLEREAFLSLVGEPKSQQRMQHMLMKGKPLRN

SEQ ID NO: 550 - protein, 790 aa, Bacillus coagulans 36D1
IQKAAVIGSGVMGSGIAAHLANIGIPVLLLDIVPNALTEAEKAKGYTLEDKAVRNRFSQSALQKLLKQKPAPLTSKKSLALIEAGNLEDDLERLKEADWIIEVVTERLDIKKSVFEKVERFRRPGTIVSSNTSGISIEAMAEGRSEDFRKHFLGTHFFNPPRYLKLLEVIPTADTDPDVTSFMKQFGEDVLGKGVVLAKDTPNFIGNRIGTYGLLVTVREMMKGGYTVGEVDSVTGPVIGRPKSATFRTLDVVGIDTFVHVANNVYEKTEGEEKEVFKVPAFMHKLVENGWLGSKTGKGFYEKKGKEIYELNPETLEYGERTKMKAASLEAARQAKGTANKIKTIVYADDRAGRLLWNILAPCLVYSAELSGVIADDILAIDQAMKWGFGWKFGPFETWDAIGVEKSVQKMEEDGLQVPGWVKGMLEKGFTSFYKEENGVVSYYDNGAYKPLPANPKEINLKALKTQGKVLKENAGASLIDIGDGVLLLEFHSKSNTIGLDILQMINYAVDEAEKHYKGIVIGNQGKNFCVGANLALMLMEAQDDNIFELDMVVRQFQNTMMKIKYSQKPVVAAPFAMTLGGGAEVCLHTAHIQAASETYMGLVETGVGLLPGGGGNKELYIKHLKNIPEGVQFDLQNVVNKVFETIAMAKVSTSAEEARESGFLDRTDGVSFNQDHLIYDAKQAVLRLADAGYKPPVREKVPVTGESGYAALLLGAQQMHLSGYISDYDLEIAKKIAFVLSGGKVPFGTKVDEQYLLDLEREAFLSLIAQPKTQQRMQHMLLKGKPLRN

SEQ ID NO: 551 - protein, 793 aa, Bacillus sp. NRRL B-14911
IQQIKKAAVLGSGVMGSGIAAHLANIGIPTLLLDIVPRELNEAEQKKGLTLEDKAVRNRISQGALQKLLKQKPAPLTSKKSLALLEAGNFEDDMESLKDVDWIIEVVVENLDIKKQVFAKVDQFRKPGSIVSSNTSGISVNSMAEGRSDDFQKHFIGTHFFNPPRYLKLLEVIPAKTTAPEVLSFMKKFGEDVLGKGVVEAKDTPNFIGNRIGTYGLLITVQEMLKGGYSVGEVDSVTGPLIGRPKSATFRTLDVVGLDTFIHVANNVYEQVDGKEKEAFEVPAFMKQMLENGWLGSKSGQGFFKKEGKEILELNPDTLEYGPRQKLKAASVEMSKQEKGLANKLKALVYADDKAGQLLWNILSPALLYSAELLGEIADDVISIDKAMKWGFGWQMGPFETWDSIGLEKSVGKMEAEGKEVPAWIKEMLSNGHTSFYKEENGDISFYKNGEYVPEEENPKNINLKKLKKQKGVIKKNTGASLLDLGDGVALLEFHSQSNAIGLDIIQMINFAVDEVEKNYKGLVIGNQGKNFSVGANLAMILMEAQDDNVFELDMVVRHFQQAMMKIKYSTKPVVAAPFAMTLGGGAEICLPAAHIQASMETYMGLVEAGVGLIPGGGGNKELYIKHLEGMPNGVEFDLQKVANKVFESIAMAKVSTSGEEARENNFLGAADGISVNGDHQLYDAKQAVLALHEQGYTPPVRKKIPVVGETGYATLLLGAQAMLYSGFISEHDLKIAQKLAYVIAGGKVPYGTEVDEQYLLDLEREAFLSLVAQPKSQQRMQHMLVKGKPLRN

SEQ ID NO: 552 - protein, 797 aa, Artificial
  Substituion in SEQ ID NO 545
MRQIRRAAVIGSGVMGAQIAAHLANVGIPSLLLDLVPQELTAEEQKKGLSLDHPAVRNRLATEAIRRLNKLSPAPLFRADYAKLITPGNLEDDLHRICEVDWVIEVIVESLEPKRQLLERIERYWHEGMIVSTNTSGISINAMVEGRSEAFRRHFLGTHFFNPPRYMKLLEVIPGRDTDPAIVEFMRDFGTERLGKGVVLAKDTPNFIANRIGTYGLLVTVEEMQKGGFTVEEVDAITGPALGRPKSATFRTLDLVGIDTFVHVANNVRQNVTDPQEQRAFEVPEAIQKLVERGWLGEKSGQGFYKRVKQNGQRQILVLDLDTFEYREQKKIASSALEASKQAKGAAGKAKALLQGGDRYAELAWNIVKRVLVYSAEKLGEIADTIQDIDAAMRWGFNWELGPFELWDALGLVETAERMRAEGLRLPSWVEDWIAAGHRAFYEEKDGKLTMPVNGKPEPVRVPAGVIDLAALKKAGKVIAQNTGASLIDLGDGVACLEFHSQNNAIGPDILTMIEKSVAIAERDFAGLVIANQGKNFCVGANLMLILMAAQEGDWDEIDLSIRQFHRAMLALRYSQVPVVAAPHRMTLGGGVEVCLASSRVLPAAETYFGLVEVGVGVIPGGGGCKETARRVAESVGPEDDLVPALARMFQAIGTAKVSTSGAEALAMGWLRETDRVVVNDDLRISAAKAEVLRMAEIGYTAPPKAKEIRVAGRDGKATLQMAARSMWNGGYITDYDLHIAYKLAHVLAGGDVPAGSLVSEDYLLDLEREAFLSLCGEPKTIQRMQHMLATGKPLRN

SEQ ID NO: 553 - protein, 797 aa, Artificial
  Substituion in SEQ ID NO 545
MRQIRRAAVIGSGVMGAQIAAHLANVGIPSLLLDLVPQELTAEEQKKGLSLDHPAVRNRLATEAIRRLQKLSPAPLFRADYAKLITPGNLEDDLHRICEVDWVIEVIVESLEPKRQLLERIERYWHEGMIVSTNTSGISINAMVEGRSEAFRRHFLGTHFFNPPRYMKLLEVIPGRDTDPAIVEFMRDFGTERLGKGVVLAKDTPNFIANRIGTYGLLVTVEEMQKGGFTVEEVDAITGPALGRPKSATFRTLDLVGIDTFVHVANNVRQNVTDPQEQRAFEVPEAIQKLVERGWLGEKSGQGFYKRVKQNGQRQILVLDLDTFEYREQKKIASSALEASKQAKGAAGKAKALLQGGDRYAELAWNIVKRVLVYSAEKLGEIADTIQDIDAAMRWGFNWELGPFELWDALGLVETAERMRAEGLRLPSWVEDWIAAGHRAFYEEKDGKLTMPVNGKPEPVRVPAGVIDLAALKKAGKVIAQNTGASLIDLGDGVACLEFHSQNNAIGPDILTMIEKSVAIAEKDFAGLVIANQGKNFCVGANLMLILMAAQEGDWDEIDLSIRQFHRAMLALRYSQVPVVAAPHRMTLGGGVEVCLASSRVLPAAETYFGLVEVGVGVIPGGGGCKETARRVAESVGPEDDLVPALARMFQAIGTAKVSTSGAEALAMGWLRETDRVVVNDDLRISAAKAEVLRMAEIGYTAPPKAKEIRVAGRDGKATLQMAARSMWNGGYITDYDLHIAYKLAHVLAGGDVPAGSLVSEDYLLDLEREAFLSLCGEPKTIQRMQHMLATGKPLRN

SEQ ID NO: 554 - protein, 797 aa, Artificial
  Substituion in SEQ ID NO 545
MRQIRRAAVIGSGVMGAQIAAHLANVGIPSLLLDLVPQELTAEEQKKGLSLDHPAVRNRLATEAIRRLNKLSPAPLFRADYAKLITPGNLEDDLHRICEVDWVIEVIVESLEPKRQLLERIERYWHEGMIVSTNTSGISINAMVEGRSEAFRRHFLGTHFFNPPRYMKLLEVIPGRDTDPAIVEFMRDFGTERLGKGVVLAKDTPNFIANRIGTYGLLVTVEEMQKGGFTVEEVDAITGPALGRPKSATFRTLDLVGIDTFVHVANNVRQNVTDPQEQRAFEVPEAIQKLVERGWLGEKSGQGFYKRVKQNGQRQILVLDLDTFEYREQKKIASSALEASKQAKGAAGKAKALLQGGDRYAELAWNIVKRVLVYSAEKLGEIADTIQDIDAAMRWGFNWELGPFELWDALGLVETAERMRAEGLRLPSWVEDWIAAGHRAFYEEKDGKLTMPVNGKPEPVRVPAGVIDLAALKKAGKVIAQNTGASLIDLGDGVACLEFHSQNNAIGPDILTMIEKSVAIAEKDFAGLVIANQGKNFCVGANLMLILMAAQEGDWEEIDLSIRQFHRAMLALRYSQVPVVAAPHRMTLGGGVEVCLASSRVLPAAETYFGLVEVGVGVIPGGGGCKETARRVAESVGPEDDLVPALARMFQAIGTAKVSTSGAEALAMGWLRETDRVVVNDDLRISAAKAEVLRMAEIGYTAPPKAKEIRVAGRDGKATLQMAARSMWNGGYITDYDLHIAYKLAHVLAGGDVPAGSLVSEDYLLDLEREAFLSLCGEPKTIQRMQHMLATGKPLRN

SEQ ID NO: 555 - protein, 797 aa, Artificial
  Substituion in SEQ ID NO 545
MRQIRRAAVIGSGVMGAQIAAHLANVGIPSLLLDLVPQELTAEEQKKGLSLDHPAVRNRLATEAIRRLNKLSPAPLFRADYAKLITPGNLEDDLHRICEVDWVIEVIVESLEPKRQLLERIERYWHEGMIVSTNTSGISINAMVEGRSEAFRRHFLGTHFFNPPRYMKLLEVIPGRDTDPAIVEFMRDFGTERLGKGVVLAKDTPNFIANRIGTYGLLVTVEEMQKGGFTVEEVDAITGPALGRPKSATFRTLDLVGIDTFVHVANNVRQNVTDPQEQRAFEVPEAIQKLVERGWLGEKSGQGFYKRVKQNGQRQILVLDLDTFEYREQKKIASSALEASKQAKGAAGKAKALLQGGDRYAELAWNIVKRVLVYSAEKLGEIADTIQDIDAAMRWGFNWELGPFELWDALGLVETAERMRAEGLRLPSWVEDWIAAGHRAFYEEKDGKLTMPVNGKPEPVRVPAGVIDLAALKKAGKVIAQNTGASLIDLGDGVACLEFHSQNNAIGPDILTMIEKSVAIAEKDFAGLVIANQGKNFCVGANLMLILMAAQEGDWDEIDLSIRQFHRAMLALRYSNVPVVAAPHRMTLGGGVEVCLASSRVLPAAETYFGLVEVGVGVIPGGGGCKETARRVAESVGPEDDLVPALARMFQAIGTAKVSTSGAEALAMGWLRETDRVVVNDDLRISAAKAEVLRMAEIGYTAPPKAKEIRVAGRDGKATLQMAARSMWNGGYITDYDLHIAYKLAHVLAGGDVPAGSLVSEDYLLDLEREAFLSLCGEPKTIQRMQHMLATGKPLRN

SEQ ID NO: 556 - protein, 797 aa, Artificial
  Substituion in SEQ ID NO 545
MRQIRRAAVIGSGVMGAQIAAHLANVGIPSLLLDLVPQELTAEEQKKGLSLDHPAVRNRLATEAIRRLNKLSPAPLFRADYAKLITPGNLEDDLHRICEVDWVIEVIVESLEPKRQLLERIERYWHEGMIVSTNTSGISINAMVEGRSEAFRRHFLGTHFFNPPRYMKLLEVIPGRDTDPAIVEFMRDFGTERLGKGVVLAKDTPNFIANRIGTYGLLVTVEEMQKGGFTVEEVDAITGPALGRPKSATFRTLDLVGIDTFVHVANNVRQNVTDPQEQRAFEVPEAIQKLVERGWLGEKSGQGFYKRVKQNGQRQILVLDLDTFEYREQKKIASSALEASKQAKGAAGKAKALLQGGDRYAELAWNIVKRVLVYSAEKLGEIADTIQDIDAAMRWGFNWELGPFELWDALGLVETAERMRAEGLRLPSWVEDWIAAGHRAFYEEKDGKLTMPVNGKPEPVRVPAGVIDLAALKKAGKVIAQNTGASLIDLGDGVACLEFHSQNNAIGPDILTMIEKSVAIAEKDFAGLVIANQGKNFCVGANLMLILMAAQEGDWDEIDLSIRQFHRAMLALRYSQVPVVAAPHRMTLGGGVEVCLASSRVLPAAETYFGLVEVGVGVIPGGGGCKETARRIAESVGPEDDLVPALARMFQAIGTAKVSTSGAEALAMGWLRETDRVVVNDDLRISAAKAEVLRMAEIGYTAPPKAKEIRVAGRDGKATLQMAARSMWNGGYITDYDLHIAYKLAHVLAGGDVPAGSLVSEDYLLDLEREAFLSLCGEPKTIQRMQHMLATGKPLRN

SEQ ID NO: 557 - DNA, 2394 bp, Artificial
  Substituion in SEQ ID NO 546
atgagacaaattcgccgagctgccgtcattggttccggcgtgatgggggcgcaaattgccgctcatctcgccaacgtgggcattccgagcctgctgttggacctcgttccgcaagagttgactgcggaagaacaaaagaaaggtttgtcgctcgatcacccagcggttcgcaaccgcctggcgacggaggccatccgtaggctgaacaagctcagcccggcgcccttgttccgcgccgactacgcgaaactcatcacgcctggaaacctcgaggacgacctgcatcggatctgcgaggtcgactgggtgattgaggtcatcgtggagagcctcgagcccaagcgccaactgctcgagcgcatcgagcgatactggcacgagggcatgattgtgagcaccaacacgtcgggcatctccatcaacgcgatggtcgaggggcgaagcgaggcgttccgccgacacttcctcggcacgcacttcttcaatcctccgcgctacatgaagctgttggaggtcattcctggccgggatacggatcccgccatcgtggagttcatgcgcgactttggaacggagcgcctcggcaaaggcgtggtgttggcgaaagacacgccgaacttcatcgccaatcgcatcggcacctacggcctcttggtgaccgtggaggagatgcaaaagggcggcttcaccgttgaggaggtcgacgccatcaccggtccggccctcgggcgcccgaagagcgcgaccttccgcacgctggatctcgtcgggatcgacacgtttgtccacgtggccaacaacgtgcgtcagaacgtgaccgatccacaggaacagcgggcgtttgaggtgccagaggccatccagaagctcgtggagcgcggatggctcggcgagaagagcggacaaggcttttataagcgcgtgaagcaaaacggccagcgccagatcctcgtgctcgatctcgacacgttcgagtaccgcgagcaaaagaagatcgcttcgtcggcgctcgaggcctcgaagcaggccaaaggggcggccggaaaggcgaaggcgctcctccagggcggcgatcggtacgcagaactcgcgtggaacatcgtcaagcgcgtgctcgtgtactcggccgagaaactgggcgagatcgcggacacgattcaggacatcgacgccgcgatgcgctggggattcaactgggagctcgggccgtttgaactctgggacgcgctcgggctggtggagactgccgagcggatgcgcgcggaagggctcaggctgccctcatgggtcgaggactggattgctgcggggcatcgcgccttctacgaagagaaagacggcaagctgaccatgccggtgaacggcaagcctgagcctgttcgggtgccggctggggtgatcgatctcgccgcgctgaagaaggcaggcaaggtcatcgcgcagaacaccggcgcgagcctcatcgacctgggcgacggggtcgcgtgcctggagttccattcgcagaacaacgccattggccccgacattctgacgatgatcgaaaagagcgtggccatcgcggagcgtgacttcgcgggcctggtcatcgcgaaccagggcaagaacttctgcgtcggcgcgaacctcatgctcatcctgatggcagcgcaggagggcgactgggacgaaattgatctctccatccgccagttccaccgcgccatgcttgcgcttcgctacagccaagtgccggtggtggcggcgcctcatcggatgacgctcggcggcggcgtcgaagtgtgcctggcgtcgtcgagggtgctgccggccgcggagacctatttcgggttggtcgaggtgggcgtcggcgtcattccgggcggcggcggctgcaaggagacggcgcgccgcgtggcggaatcggtcggccccgaagacgatctcgtccccgctctagcccgcatgttccaggccatcggcaccgccaaggtgtcgacgagtggcgccgaggccctggcgatgggctggctgcgcgagacggatcgcgtggtggtgaacgacgacctgcgcatctcggccgcgaaggcggaggtgcttcgcatggctgagattggctacaccgcgccgccgaaggcgaaggaaattcgcgtcgcgggccgcgacggcaaggcgaccttgcagatggccgcgcgcagcatgtggaacggtggctacatcacggattacgacctccacatcgcctacaagctcgcgcatgtgctggcgggcggcgacgtgccggcgggctccctcgtgagcgaggactacctgctcgatctcgagcgcgaggcgttcctcagcctgtgcggagagccgaagaccatccagcgcatgcagcacatgctcgccaccgggaagccgcttcgcaactga

SEQ ID NO: 558 - DNA, 2394 bp, Artificial
  Substituion in SEQ ID NO 546
atgagacaaattcgccgagctgccgtcattggttccggcgtgatgggggcgcaaattgccgctcatctcgccaacgtgggcattccgagcctgctgttggacctcgttccgcaagagttgactgcggaagaacaaaagaaaggtttgtcgctcgatcacccagcggttcgcaaccgcctggcgacggaggccatccgtaggctgcaaaagctcagcccggcgcccttgttccgcgccgactacgcgaaactcatcacgcctggaaacctcgaggacgacctgcatcggatctgcgaggtcgactgggtgattgaggtcatcgtggagagcctcgagcccaagcgccaactgctcgagcgcatcgagcgatactggcacgagggcatgattgtgagcaccaacacgtcgggcatctccatcaacgcgatggtcgaggggcgaagcgaggcgttccgccgacacttcctcggcacgcacttcttcaatcctccgcgctacatgaagctgttggaggtcattcctggccgggatacggatcccgccatcgtggagttcatgcgcgactttggaacggagcgcctcggcaaaggcgtggtgttggcgaaagacacgccgaacttcatcgccaatcgcatcggcacctacggcctcttggtgaccgtggaggagatgcaaaagggcggcttcaccgttgaggaggtcgacgccatcaccggtccggccctcgggcgcccgaagagcgcgaccttccgcacgctggatctcgtcgggatcgacacgtttgtccacgtggccaacaacgtgcgtcagaacgtgaccgatccacaggaacagcgggcgtttgaggtgccagaggccatccagaagctcgtggagcgcggatggctcggcgagaagagcggacaaggcttttataagcgcgtgaagcaaaacggccagcgccagatcctcgtgctcgatctcgacacgttcgagtaccgcgagcaaaagaagatcgcttcgtcggcgctcgaggcctcgaagcaggccaaaggggcggccggaaaggcgaaggcgctcctccagggcggcgatcggtacgcagaactcgcgtggaacatcgtcaagcgcgtgctcgtgtactcggccgagaaactgggcgagatcgcggacacgattcaggacatcgacgccgcgatgcgctggggattcaactgggagctcgggccgtttgaactctgggacgcgctcgggctggtggagactgccgagcggatgcgcgcggaagggctcaggctgccctcatgggtcgaggactggattgctgcggggcatcgcgccttctacgaagagaaagacggcaagctgaccatgccggtgaacggcaagcctgagcctgttcgggtgccggctggggtgatcgatctcgccgcgctgaagaaggcaggcaaggtcatcgcgcagaacaccggcgcgagcctcatcgacctgggcgacggggtcgcgtgcctggagttccattcgcagaacaacgccattggccccgacattctgacgatgatcgaaaagagcgtggccatcgcggagaaagacttcgcgggcctggtcatcgcgaaccagggcaagaacttctgcgtcggcgcgaacctcatgctcatcctgatggcagcgcaggagggcgactgggacgaaattgatctctccatccgccagttccaccgcgccatgcttgcgcttcgctacagccaagtgccggtggtggcggcgcctcatcggatgacgctcggcggcggcgtcgaagtgtgcctggcgtcgtcgagggtgctgccggccgcggagacctatttcgggttggtcgaggtgggcgtcggcgtcattccgggcggcggcggctgcaaggagacggcgcgccgcgtggcggaatcggtcggccccgaagacgatctcgtccccgctctagcccgcatgttccaggccatcggcaccgccaaggtgtcgacgagtggcgccgaggccctggcgatgggctggctgcgcgagacggatcgcgtggtggtgaacgacgacctgcgcatctcggccgcgaaggcggaggtgcttcgcatggctgagattggctacaccgcgccgccgaaggcgaaggaaattcgcgtcgcgggccgcgacggcaaggcgaccttgcagatggccgcgcgcagcatgtggaacggtggctacatcacggattacgacctccacatcgcctacaagctcgcgcatgtgctggcgggcggcgacgtgccggcgggctccctcgtgagcgaggactacctgctcgatctcgagcgcgaggcgttcctcagcctgtgcggagagccgaagaccatccagcgcatgcagcacatgctcgccaccgggaagccgcttcgcaactga

SEQ ID NO: 559 - DNA, 2394 bp, Artificial
  Substituion in SEQ ID NO 546
atgagacaaattcgccgagctgccgtcattggttccggcgtgatgggggcgcaaattgccgctcatctcgccaacgtgggcattccgagcctgctgttggacctcgttccgcaagagttgactgcggaagaacaaaagaaaggtttgtcgctcgatcacccagcggttcgcaaccgcctggcgacggaggccatccgtaggctgaacaagctcagcccggcgcccttgttccgcgccgactacgcgaaactcatcacgcctggaaacctcgaggacgacctgcatcggatctgcgaggtcgactgggtgattgaggtcatcgtggagagcctcgagcccaagcgccaactgctcgagcgcatcgagcgatactggcacgagggcatgattgtgagcaccaacacgtcgggcatctccatcaacgcgatggtcgaggggcgaagcgaggcgttccgccgacacttcctcggcacgcacttcttcaatcctccgcgctacatgaagctgttggaggtcattcctggccgggatacggatcccgccatcgtggagttcatgcgcgactttggaacggagcgcctcggcaaaggcgtggtgttggcgaaagacacgccgaacttcatcgccaatcgcatcggcacctacggcctcttggtgaccgtggaggagatgcaaaagggcggcttcaccgttgaggaggtcgacgccatcaccggtccggccctcgggcgcccgaagagcgcgaccttccgcacgctggatctcgtcgggatcgacacgtttgtccacgtggccaacaacgtgcgtcagaacgtgaccgatccacaggaacagcgggcgtttgaggtgccagaggccatccagaagctcgtggagcgcggatggctcggcgagaagagcggacaaggcttttataagcgcgtgaagcaaaacggccagcgccagatcctcgtgctcgatctcgacacgttcgagtaccgcgagcaaaagaagatcgcttcgtcggcgctcgaggcctcgaagcaggccaaaggggcggccggaaaggcgaaggcgctcctccagggcggcgatcggtacgcagaactcgcgtggaacatcgtcaagcgcgtgctcgtgtactcggccgagaaactgggcgagatcgcggacacgattcaggacatcgacgccgcgatgcgctggggattcaactgggagctcgggccgtttgaactctgggacgcgctcgggctggtggagactgccgagcggatgcgcgcggaagggctcaggctgccctcatgggtcgaggactggattgctgcggggcatcgcgccttctacgaagagaaagacggcaagctgaccatgccggtgaacggcaagcctgagcctgttcgggtgccggctggggtgatcgatctcgccgcgctgaagaaggcaggcaaggtcatcgcgcagaacaccggcgcgagcctcatcgacctgggcgacggggtcgcgtgcctggagttccattcgcagaacaacgccattggccccgacattctgacgatgatcgaaaagagcgtggccatcgcggagaaagacttcgcgggcctggtcatcgcgaaccagggcaagaacttctgcgtcggcgcgaacctcatgctcatcctgatggcagcgcaggagggcgactgggaagaaattgatctctccatccgccagttccaccgcgccatgcttgcgcttcgctacagccaagtgccggtggtggcggcgcctcatcggatgacgctcggcggcggcgtcgaagtgtgcctggcgtcgtcgagggtgctgccggccgcggagacctatttcgggttggtcgaggtgggcgtcggcgtcattccgggcggcggcggctgcaaggagacggcgcgccgcgtggcggaatcggtcggccccgaagacgatctcgtccccgctctagcccgcatgttccaggccatcggcaccgccaaggtgtcgacgagtggcgccgaggccctggcgatgggctggctgcgcgagacggatcgcgtggtggtgaacgacgacctgcgcatctcggccgcgaaggcggaggtgcttcgcatggctgagattggctacaccgcgccgccgaaggcgaaggaaattcgcgtcgcgggccgcgacggcaaggcgaccttgcagatggccgcgcgcagcatgtggaacggtggctacatcacggattacgacctccacatcgcctacaagctcgcgcatgtgctggcgggcggcgacgtgccggcgggctccctcgtgagcgaggactacctgctcgatctcgagcgcgaggcgttcctcagcctgtgcggagagccgaagaccatccagcgcatgcagcacatgctcgccaccgggaagccgcttcgcaactga

SEQ ID NO: 560 - DNA, 2394 bp, Artificial
  Substituion in SEQ ID NO 546
atgagacaaattcgccgagctgccgtcattggttccggcgtgatgggggcgcaaattgccgctcatctcgccaacgtgggcattccgagcctgctgttggacctcgttccgcaagagttgactgcggaagaacaaaagaaaggtttgtcgctcgatcacccagcggttcgcaaccgcctggcgacggaggccatccgtaggctgaacaagctcagcccggcgcccttgttccgcgccgactacgcgaaactcatcacgcctggaaacctcgaggacgacctgcatcggatctgcgaggtcgactgggtgattgaggtcatcgtggagagcctcgagcccaagcgccaactgctcgagcgcatcgagcgatactggcacgagggcatgattgtgagcaccaacacgtcgggcatctccatcaacgcgatggtcgaggggcgaagcgaggcgttccgccgacacttcctcggcacgcacttcttcaatcctccgcgctacatgaagctgttggaggtcattcctggccgggatacggatcccgccatcgtggagttcatgcgcgactttggaacggagcgcctcggcaaaggcgtggtgttggcgaaagacacgccgaacttcatcgccaatcgcatcggcacctacggcctcttggtgaccgtggaggagatgcaaaagggcggcttcaccgttgaggaggtcgacgccatcaccggtccggccctcgggcgcccgaagagcgcgaccttccgcacgctggatctcgtcgggatcgacacgtttgtccacgtggccaacaacgtgcgtcagaacgtgaccgatccacaggaacagcgggcgtttgaggtgccagaggccatccagaagctcgtggagcgcggatggctcggcgagaagagcggacaaggcttttataagcgcgtgaagcaaaacggccagcgccagatcctcgtgctcgatctcgacacgttcgagtaccgcgagcaaaagaagatcgcttcgtcggcgctcgaggcctcgaagcaggccaaaggggcggccggaaaggcgaaggcgctcctccagggcggcgatcggtacgcagaactcgcgtggaacatcgtcaagcgcgtgctcgtgtactcggccgagaaactgggcgagatcgcggacacgattcaggacatcgacgccgcgatgcgctggggattcaactgggagctcgggccgtttgaactctgggacgcgctcgggctggtggagactgccgagcggatgcgcgcggaagggctcaggctgccctcatgggtcgaggactggattgctgcggggcatcgcgccttctacgaagagaaagacggcaagctgaccatgccggtgaacggcaagcctgagcctgttcgggtgccggctggggtgatcgatctcgccgcgctgaagaaggcaggcaaggtcatcgcgcagaacaccggcgcgagcctcatcgacctgggcgacggggtcgcgtgcctggagttccattcgcagaacaacgccattggccccgacattctgacgatgatcgaaaagagcgtggccatcgcggagaaagacttcgcgggcctggtcatcgcgaaccagggcaagaacttctgcgtcggcgcgaacctcatgctcatcctgatggcagcgcaggagggcgactgggacgaaattgatctctccatccgccagttccaccgcgccatgcttgcgcttcgctacagcaatgtgccggtggtggcggcgcctcatcggatgacgctcggcggcggcgtcgaagtgtgcctggcgtcgtcgagggtgctgccggccgcggagacctatttcgggttggtcgaggtgggcgtcggcgtcattccgggcggcggcggctgcaaggagacggcgcgccgcgtggcggaatcggtcggccccgaagacgatctcgtccccgctctagcccgcatgttccaggccatcggcaccgccaaggtgtcgacgagtggcgccgaggccctggcgatgggctggctgcgcgagacggatcgcgtggtggtgaacgacgacctgcgcatctcggccgcgaaggcggaggtgcttcgcatggctgagattggctacaccgcgccgccgaaggcgaaggaaattcgcgtcgcgggccgcgacggcaaggcgaccttgcagatggccgcgcgcagcatgtggaacggtggctacatcacggattacgacctccacatcgcctacaagctcgcgcatgtgctggcgggcggcgacgtgccggcgggctccctcgtgagcgaggactacctgctcgatctcgagcgcgaggcgttcctcagcctgtgcggagagccgaagaccatccagcgcatgcagcacatgctcgccaccgggaagccgcttcgcaactga

SEQ ID NO: 561 - DNA, 2394 bp, Artificial
  Substituion in SEQ ID NO 546
atgagacaaattcgccgagctgccgtcattggttccggcgtgatgggggcgcaaattgccgctcatctcgccaacgtgggcattccgagcctgctgttggacctcgttccgcaagagttgactgcggaagaacaaaagaaaggtttgtcgctcgatcacccagcggttcgcaaccgcctggcgacggaggccatccgtaggctgaacaagctcagcccggcgcccttgttccgcgccgactacgcgaaactcatcacgcctggaaacctcgaggacgacctgcatcggatctgcgaggtcgactgggtgattgaggtcatcgtggagagcctcgagcccaagcgccaactgctcgagcgcatcgagcgatactggcacgagggcatgattgtgagcaccaacacgtcgggcatctccatcaacgcgatggtcgaggggcgaagcgaggcgttccgccgacacttcctcggcacgcacttcttcaatcctccgcgctacatgaagctgttggaggtcattcctggccgggatacggatcccgccatcgtggagttcatgcgcgactttggaacggagcgcctcggcaaaggcgtggtgttggcgaaagacacgccgaacttcatcgccaatcgcatcggcacctacggcctcttggtgaccgtggaggagatgcaaaagggcggcttcaccgttgaggaggtcgacgccatcaccggtccggccctcgggcgcccgaagagcgcgaccttccgcacgctggatctcgtcgggatcgacacgtttgtccacgtggccaacaacgtgcgtcagaacgtgaccgatccacaggaacagcgggcgtttgaggtgccagaggccatccagaagctcgtggagcgcggatggctcggcgagaagagcggacaaggcttttataagcgcgtgaagcaaaacggccagcgccagatcctcgtgctcgatctcgacacgttcgagtaccgcgagcaaaagaagatcgcttcgtcggcgctcgaggcctcgaagcaggccaaaggggcggccggaaaggcgaaggcgctcctccagggcggcgatcggtacgcagaactcgcgtggaacatcgtcaagcgcgtgctcgtgtactcggccgagaaactgggcgagatcgcggacacgattcaggacatcgacgccgcgatgcgctggggattcaactgggagctcgggccgtttgaactctgggacgcgctcgggctggtggagactgccgagcggatgcgcgcggaagggctcaggctgccctcatgggtcgaggactggattgctgcggggcatcgcgccttctacgaagagaaagacggcaagctgaccatgccggtgaacggcaagcctgagcctgttcgggtgccggctggggtgatcgatctcgccgcgctgaagaaggcaggcaaggtcatcgcgcagaacaccggcgcgagcctcatcgacctgggcgacggggtcgcgtgcctggagttccattcgcagaacaacgccattggccccgacattctgacgatgatcgaaaagagcgtggccatcgcggagaaagacttcgcgggcctggtcatcgcgaaccagggcaagaacttctgcgtcggcgcgaacctcatgctcatcctgatggcagcgcaggagggcgactgggacgaaattgatctctccatccgccagttccaccgcgccatgcttgcgcttcgctacagccaagtgccggtggtggcggcgcctcatcggatgacgctcggcggcggcgtcgaagtgtgcctggcgtcgtcgagggtgctgccggccgcggagacctatttcgggttggtcgaggtgggcgtcggcgtcattccgggcggcggcggctgcaaggagacggcgcgccgcattgcggaatcggtcggccccgaagacgatctcgtccccgctctagcccgcatgttccaggccatcggcaccgccaaggtgtcgacgagtggcgccgaggccctggcgatgggctggctgcgcgagacggatcgcgtggtggtgaacgacgacctgcgcatctcggccgcgaaggcggaggtgcttcgcatggctgagattggctacaccgcgccgccgaaggcgaaggaaattcgcgtcgcgggccgcgacggcaaggcgaccttgcagatggccgcgcgcagcatgtggaacggtggctacatcacggattacgacctccacatcgcctacaagctcgcgcatgtgctggcgggcggcgacgtgccggcgggctccctcgtgagcgaggactacctgctcgatctcgagcgcgaggcgttcctcagcctgtgcggagagccgaagaccatccagcgcatgcagcacatgctcgccaccgggaagccgcttcgcaactga

SEQ ID NO: 562 - protein, 360 aa, Alicyclobacillus acidocaldarius
MHICFESAEEVEGMQVKARGVLSKESPFHAIKIERRELQPDDVLIEIHYCGICHSDIHSARGEWGEVRYPFVPGHEITGIVSKVGSQVTKFKPGDRVGVGCMVDSCGECENCKRGDEQYCVKGNIQTYGSVDRYGQYTMGGYSTHIVVKEDFVLRIPDALPLDKAAPLLCAGITTYSPLRHWQAGPGKEVAVVGLGGLGHMAVKLAKAMGAKVTVLSQSLRKKEDGLRLGAKAYYATSDPETFRQLAGRFDLIINTVSAKIPITEYLGLLKTDGALVNVGAPPEPLEVNAFALIAQRRTFAGSCIGGIRETQEMLDFCAESGVTPEIEVISADEIDAAWERVLKSDVRYRFVIDISTMRN

SEQ ID NO: 563 - DNA, 1083 bp, Alicyclobacillus acidocaldarius
ttgcacatctgtttcgaatcggcagaggaggtcgaagggatgcaggtcaaggctcgcggcgtgttgagcaaggagagcccgtttcatgccatcaagatcgagcggcgggagcttcagcccgacgatgtgctgattgaaatccactactgcggcatctgccactccgacatccactcggcccgcggcgagtggggcgaggtgcggtatccattcgtgcccgggcatgagatcaccggcatcgtctcgaaggtcggcagccaggtgaccaagttcaagccgggcgatcgcgtcggcgtgggatgcatggtcgactcgtgcggcgaatgcgagaactgtaagcgcggcgacgagcagtactgcgtgaagggcaacatccagacgtacggcagtgtcgaccgctacgggcagtacaccatgggcggctactccacgcacatcgtggtgaaggaggacttcgtcctccgcatcccggatgcgctgcctctggacaaggcggcgccgcttctgtgcgcgggcatcacgacgtactcgccgcttcgccactggcaggcgggcccgggaaaggaggtcgccgtcgtcggcctcggggggctcggtcacatggccgtgaagctcgcgaaggcgatgggggcgaaggtcaccgtgctctcccagtccctgcggaaaaaggaggacggcctgcgcctcggcgcgaaagcctactacgcgacgagcgatcccgagacattccgccagctcgccggacgcttcgatctcatcatcaacacggtgtcggcgaagatccccatcactgagtatctgggccttctgaagacggatggcgctctggtcaacgtcggcgcgccgccggagccgctcgaggtgaacgcgtttgcgctcatcgcacagcgccgcacgtttgcgggctcctgcatcggcggcatccgcgagacgcaggagatgctcgatttctgcgctgagagcggtgtgacgcccgagatcgaggtcatctcggcggacgagatcgacgcggcgtgggagcgggtgctgaagtcggacgtgcggtatcgattcgtgatcgacatcagcacgatgcgcaattga

SEQ ID NO: 564 - protein, 342 aa, Oceanobacillus iheyensis HTE831
KARAVDGPHQPFHATEIKRRNLDSHDVLIEIKYSGICHSDIHTAHGEWGEVNYPLVPGHEIAGVVSDVGPEVTKYKVGDRVGVGCMVDSCGECENCRRGEEQYCHQGNVQTYGGVDKYGEPTQGGYSTHIVVTEDFVLRIPDNIELDVAAPLLCAGITTYSPLNHWNAGPGKKVAVVGMGGLGHMAVKIAHAMGAEVTVLSRTLNKKEDGLEFGAENYYATSEKETFETLAGSFDLIINTVSAKLDMDAYFSLLNLDGSLVNVGAPAEPLSVNVFSLIGHRRSFAGSLIGGIRETQEMLDFCAEHNIVPKIEVISADQIDEAYTRVLDSDVKYRFVIDVSTI

SEQ ID NO: 565 - protein, 326 aa, Arthrobacter sp. FB24
IERRDVGPHDVLIGIKFAGICHSDIHTVRGDWGPQQYPLAPGHEIAGIVTDVGSEVTKHAVGDRVGVGCMVNSCRECVNCQKGEEQYCLKGNIGTYGAVDRDGTITQGGYSTHVVVTEDFVVRIPEGIELDVAAPLLCAGITTYSPLHHWGAGPGKKVAVVGLGGLGHMAVKIAHAMGAEVTVLSQSLKKQEDGLKLGADHYYATSDENTFSDLAGSFDLIINTVSASIDISSYLQLLTLDGALVNVGAPAEPLPVNAFALIAGRRSFAGSMIGGIRETQEMLDFCAEHNLGAEIEVIPAEKINEAYERVLASDVRYRFVIDTATL

SEQ ID NO: 566 - protein, 326 aa, Arthrobacter aurescens TC1
IERREVGPNDVHIDIKFAGICHSDIHTVRGDWGPQQYPLAPGHEIAGIVTEVGSDVTKHKVGDRVGVGCMVNSCKECKNCLAGEEQYCLKGNVGTYGSVDRDGTITQGGYSSHVVVNEDFVVTIPEGLDLDVAAPLLCAGITTYSPLHHWGAGPGKKVAVVGLGGLGHMAVKIAHAMGAEVTVLSQSLKKMEDGLKLGADHYYATSDPATFEQLGGTFDLIVNTVSASIDISAYLQLLTLDGTLVNVGAPAEPLPVNVFSLITGRRRFAGSAIGGIRETQEMLNFCAEHGLGAEIEVIPASKINDAYERVLASDVRYRFVIDVSTI

SEQ ID NO: 567 - protein, 343 aa, Clavibacter michiganensis subsp. michiganensis NCPPB 382
VNAYAATSATDPITKTTIERRDVGPKDVSIDIAYSGVCHSDIHTVRGEWGPIAYPQVVGHEIVGRVTEVGSEVSKHEVGDLVGVGCMVNSCKECEQCKAGQEQYCLKGNIQTYGGTDPADGTITQGGYSEAVVVDEDFVLRVPESLDIEKVAPLLCAGITTYSPLRHWNAGPGTKVAVVGMGGLGHMAVKIAHAMGAEVTVLSQTLSKKEDGLRLGADRYFATSDDATFTELASSFDLIINTVSAKLDMSKYIGLLAIDGTLVNVGAPSEPLEIPAFALIPARRSWAGSMIGGIAETQEMLDFCAEHGIVPETELISAEQINEAYERVLKSDVRYRFVIDAKT

SEQ ID NO: 568 - protein, 346 aa, Mycobacterium smegmatis str. MC2 155
VSAYAATSATEPLTKTTITRRAVGPHDVAFDIHFAGICHSDIHTVKAEWGVPNYPVVPGHEIAGVVTEVGSEVTKYKVGDRVGVGCFVDSCRECDNCKAGLEQYCTGTGMVGTYNAIDRDGTPTHGGYSGAIVVDENYVLRIPDSLPLDAAAPLLCAGITTYSPLRHWNAGPGKKVAVIGLGGLGHVAVKLAKAMGADVTVLSQSLKKMEDGLRLGASAYYATSDPETFDKLAGSFDLILNTVSANLDLGAYLGLLKLDGALVELGLPEHPMEVPAFPLLAQRRNLTGSMIGGIPETQEMLDFCAEHDVRPEIEIITPDYINEAYERVLASDVRYRFVIDTASLRS

SEQ ID NO: 569 - protein, 360 aa, Artificial
  Substituion in SEQ ID NO 562
MHICFESAEEVEGMQVKARGVLSKESPFHALKIERRELQPDDVLIEIHYCGICHSDIHSARGEWGEVRYPFVPGHEITGIVSKVGSQVTKFKPGDRVGVGCMVDSCGECENCKRGDEQYCVKGNIQTYGSVDRYGQYTMGGYSTHIVVKEDFVLRIPDALPLDKAAPLLCAGITTYSPLRHWQAGPGKEVAVVGLGGLGHMAVKLAKAMGAKVTVLSQSLRKKEDGLRLGAKAYYATSDPETFRQLAGRFDLIINTVSAKIPITEYLGLLKTDGALVNVGAPPEPLEVNAFALIAQRRTFAGSCIGGIRETQEMLDFCAESGVTPEIEVISADEIDAAWERVLKSDVRYRFVIDISTMRN

SEQ ID NO: 570 - protein, 360 aa, Artificial
  Substituion in SEQ ID NO 562
MHICFESAEEVEGMQIKARGVLSKESPFHAIKIERRELQPDDVLIEIHYCGICHSDIHSARGEWGEVRYPFVPGHEITGIVSKVGSQVTKFKPGDRVGVGCMVDSCGECENCKRGDEQYCVKGNIQTYGSVDRYGQYTMGGYSTHIVVKEDFVLRIPDALPLDKAAPLLCAGITTYSPLRHWQAGPGKEVAVVGLGGLGHMAVKLAKAMGAKVTVLSQSLRKKEDGLRLGAKAYYATSDPETFRQLAGRFDLIINTVSAKIPITEYLGLLKTDGALVNVGAPPEPLEVNAFALIAQRRTFAGSCIGGIRETQEMLDFCAESGVTPEIEVISADEIDAAWERVLKSDVRYRFVIDISTMRN

SEQ ID NO: 571 - protein, 360 aa, Artificial
  Substituion in SEQ ID NO 562
MHICFESAEEVEGMQVKARGVLSKESPFHAIKIERRELQPDDVLIEIHYCGICHSDIHSARGEWGEVRYPFVPGHEITGIVSKVGSQVTKFKPGDRVGVGCMVDSCGECENCKRGDEQYCIKGNIQTYGSVDRYGQYTMGGYSTHIVVKEDFVLRIPDALPLDKAAPLLCAGITTYSPLRHWQAGPGKEVAVVGLGGLGHMAVKLAKAMGAKVTVLSQSLRKKEDGLRLGAKAYYATSDPETFRQLAGRFDLIINTVSAKIPITEYLGLLKTDGALVNVGAPPEPLEVNAFALIAQRRTFAGSCIGGIRETQEMLDFCAESGVTPEIEVISADEIDAAWERVLKSDVRYRFVIDISTMRN

SEQ ID NO: 572 - protein, 360 aa, Artificial
  Substituion in SEQ ID NO 562
MHICFESAEEVEGMQVKARGVLSKESPFHAIKIERRELQPDDVLIEIHYCGICHSDIHSARGEWGDVRYPFVPGHEITGIVSKVGSQVTKFKPGDRVGVGCMVDSCGECENCKRGDEQYCVKGNIQTYGSVDRYGQYTMGGYSTHIVVKEDFVLRIPDALPLDKAAPLLCAGITTYSPLRHWQAGPGKEVAVVGLGGLGHMAVKLAKAMGAKVTVLSQSLRKKEDGLRLGAKAYYATSDPETFRQLAGRFDLIINTVSAKIPITEYLGLLKTDGALVNVGAPPEPLEVNAFALIAQRRTFAGSCIGGIRETQEMLDFCAESGVTPEIEVISADEIDAAWERVLKSDVRYRFVIDISTMRN

SEQ ID NO: 573 - protein, 360 aa, Artificial
  Substituion in SEQ ID NO 562
MHICFESAEEVEGMQVKARGVLSKESPFHAIKIERRELQPDDVLIEIHYCGICHSDIHSARGEWGEVRYPFVPGHEITGIVSKVGSQVTKFKPGDRVGVGCMVDSCGECENCKRGDEQYCVKGNIQTYGSVDRYGQYTMGGYSTHIVVKEDFVLRIPDALPLDKAAPLLCAGITTYSPLRHWQAGPGKEVAVVGLGGLGHMAVKLAKAMGAKVTVLSQSLRKKEDGLRLGAKAYYATSDPETFRQLAGRFDLIINTVSAKIPITEYLGLLKTDGALVNVGAPPEPLEVNAFALIAQRRTFAGSCIGGIRETQEMLDFCAESGVTPEIEVISADEIDAAWERVLKSDVRYRFVIDLSTMRN

SEQ ID NO: 574 - DNA, 1083 bp, Artificial
  Substituion in SEQ ID NO 563
ttgcacatctgtttcgaatcggcagaggaggtcgaagggatgcaggtcaaggctcgcggcgtgttgagcaaggagagcccgtttcatgccttaaagatcgagcggcgggagcttcagcccgacgatgtgctgattgaaatccactactgcggcatctgccactccgacatccactcggcccgcggcgagtggggcgaggtgcggtatccattcgtgcccgggcatgagatcaccggcatcgtctcgaaggtcggcagccaggtgaccaagttcaagccgggcgatcgcgtcggcgtgggatgcatggtcgactcgtgcggcgaatgcgagaactgtaagcgcggcgacgagcagtactgcgtgaagggcaacatccagacgtacggcagtgtcgaccgctacgggcagtacaccatgggcggctactccacgcacatcgtggtgaaggaggacttcgtcctccgcatcccggatgcgctgcctctggacaaggcggcgccgcttctgtgcgcgggcatcacgacgtactcgccgcttcgccactggcaggcgggcccgggaaaggaggtcgccgtcgtcggcctcggggggctcggtcacatggccgtgaagctcgcgaaggcgatgggggcgaaggtcaccgtgctctcccagtccctgcggaaaaaggaggacggcctgcgcctcggcgcgaaagcctactacgcgacgagcgatcccgagacattccgccagctcgccggacgcttcgatctcatcatcaacacggtgtcggcgaagatccccatcactgagtatctgggccttctgaagacggatggcgctctggtcaacgtcggcgcgccgccggagccgctcgaggtgaacgcgtttgcgctcatcgcacagcgccgcacgtttgcgggctcctgcatcggcggcatccgcgagacgcaggagatgctcgatttctgcgctgagagcggtgtgacgcccgagatcgaggtcatctcggcggacgagatcgacgcggcgtgggagcgggtgctgaagtcggacgtgcggtatcgattcgtgatcgacatcagcacgatgcgcaattga

SEQ ID NO: 575 - DNA, 1083 bp, Artificial
  Substituion in SEQ ID NO 563
ttgcacatctgtttcgaatcggcagaggaggtcgaagggatgcagattaaggctcgcggcgtgttgagcaaggagagcccgtttcatgccatcaagatcgagcggcgggagcttcagcccgacgatgtgctgattgaaatccactactgcggcatctgccactccgacatccactcggcccgcggcgagtggggcgaggtgcggtatccattcgtgcccgggcatgagatcaccggcatcgtctcgaaggtcggcagccaggtgaccaagttcaagccgggcgatcgcgtcggcgtgggatgcatggtcgactcgtgcggcgaatgcgagaactgtaagcgcggcgacgagcagtactgcgtgaagggcaacatccagacgtacggcagtgtcgaccgctacgggcagtacaccatgggcggctactccacgcacatcgtggtgaaggaggacttcgtcctccgcatcccggatgcgctgcctctggacaaggcggcgccgcttctgtgcgcgggcatcacgacgtactcgccgcttcgccactggcaggcgggcccgggaaaggaggtcgccgtcgtcggcctcggggggctcggtcacatggccgtgaagctcgcgaaggcgatgggggcgaaggtcaccgtgctctcccagtccctgcggaaaaaggaggacggcctgcgcctcggcgcgaaagcctactacgcgacgagcgatcccgagacattccgccagctcgccggacgcttcgatctcatcatcaacacggtgtcggcgaagatccccatcactgagtatctgggccttctgaagacggatggcgctctggtcaacgtcggcgcgccgccggagccgctcgaggtgaacgcgtttgcgctcatcgcacagcgccgcacgtttgcgggctcctgcatcggcggcatccgcgagacgcaggagatgctcgatttctgcgctgagagcggtgtgacgcccgagatcgaggtcatctcggcggacgagatcgacgcggcgtgggagcgggtgctgaagtcggacgtgcggtatcgattcgtgatcgacatcagcacgatgcgcaattga

SEQ ID NO: 576 - DNA, 1083 bp, Artificial
  Substituion in SEQ ID NO 563
ttgcacatctgtttcgaatcggcagaggaggtcgaagggatgcaggtcaaggctcgcggcgtgttgagcaaggagagcccgtttcatgccatcaagatcgagcggcgggagcttcagcccgacgatgtgctgattgaaatccactactgcggcatctgccactccgacatccactcggcccgcggcgagtggggcgaggtgcggtatccattcgtgcccgggcatgagatcaccggcatcgtctcgaaggtcggcagccaggtgaccaagttcaagccgggcgatcgcgtcggcgtgggatgcatggtcgactcgtgcggcgaatgcgagaactgtaagcgcggcgacgagcagtactgcattaagggcaacatccagacgtacggcagtgtcgaccgctacgggcagtacaccatgggcggctactccacgcacatcgtggtgaaggaggacttcgtcctccgcatcccggatgcgctgcctctggacaaggcggcgccgcttctgtgcgcgggcatcacgacgtactcgccgcttcgccactggcaggcgggcccgggaaaggaggtcgccgtcgtcggcctcggggggctcggtcacatggccgtgaagctcgcgaaggcgatgggggcgaaggtcaccgtgctctcccagtccctgcggaaaaaggaggacggcctgcgcctcggcgcgaaagcctactacgcgacgagcgatcccgagacattccgccagctcgccggacgcttcgatctcatcatcaacacggtgtcggcgaagatccccatcactgagtatctgggccttctgaagacggatggcgctctggtcaacgtcggcgcgccgccggagccgctcgaggtgaacgcgtttgcgctcatcgcacagcgccgcacgtttgcgggctcctgcatcggcggcatccgcgagacgcaggagatgctcgatttctgcgctgagagcggtgtgacgcccgagatcgaggtcatctcggcggacgagatcgacgcggcgtgggagcgggtgctgaagtcggacgtgcggtatcgattcgtgatcgacatcagcacgatgcgcaattga

SEQ ID NO: 577 - DNA, 1083 bp, Artificial
  Substituion in SEQ ID NO 563
ttgcacatctgtttcgaatcggcagaggaggtcgaagggatgcaggtcaaggctcgcggcgtgttgagcaaggagagcccgtttcatgccatcaagatcgagcggcgggagcttcagcccgacgatgtgctgattgaaatccactactgcggcatctgccactccgacatccactcggcccgcggcgagtggggcgatgtgcggtatccattcgtgcccgggcatgagatcaccggcatcgtctcgaaggtcggcagccaggtgaccaagttcaagccgggcgatcgcgtcggcgtgggatgcatggtcgactcgtgcggcgaatgcgagaactgtaagcgcggcgacgagcagtactgcgtgaagggcaacatccagacgtacggcagtgtcgaccgctacgggcagtacaccatgggcggctactccacgcacatcgtggtgaaggaggacttcgtcctccgcatcccggatgcgctgcctctggacaaggcggcgccgcttctgtgcgcgggcatcacgacgtactcgccgcttcgccactggcaggcgggcccgggaaaggaggtcgccgtcgtcggcctcggggggctcggtcacatggccgtgaagctcgcgaaggcgatgggggcgaaggtcaccgtgctctcccagtccctgcggaaaaaggaggacggcctgcgcctcggcgcgaaagcctactacgcgacgagcgatcccgagacattccgccagctcgccggacgcttcgatctcatcatcaacacggtgtcggcgaagatccccatcactgagtatctgggccttctgaagacggatggcgctctggtcaacgtcggcgcgccgccggagccgctcgaggtgaacgcgtttgcgctcatcgcacagcgccgcacgtttgcgggctcctgcatcggcggcatccgcgagacgcaggagatgctcgatttctgcgctgagagcggtgtgacgcccgagatcgaggtcatctcggcggacgagatcgacgcggcgtgggagcgggtgctgaagtcggacgtgcggtatcgattcgtgatcgacatcagcacgatgcgcaattga

SEQ ID NO: 578 - DNA, 1083 bp, Artificial
  Substituion in SEQ ID NO 563
ttgcacatctgtttcgaatcggcagaggaggtcgaagggatgcaggtcaaggctcgcggcgtgttgagcaaggagagcccgtttcatgccatcaagatcgagcggcgggagcttcagcccgacgatgtgctgattgaaatccactactgcggcatctgccactccgacatccactcggcccgcggcgagtggggcgaggtgcggtatccattcgtgcccgggcatgagatcaccggcatcgtctcgaaggtcggcagccaggtgaccaagttcaagccgggcgatcgcgtcggcgtgggatgcatggtcgactcgtgcggcgaatgcgagaactgtaagcgcggcgacgagcagtactgcgtgaagggcaacatccagacgtacggcagtgtcgaccgctacgggcagtacaccatgggcggctactccacgcacatcgtggtgaaggaggacttcgtcctccgcatcccggatgcgctgcctctggacaaggcggcgccgcttctgtgcgcgggcatcacgacgtactcgccgcttcgccactggcaggcgggcccgggaaaggaggtcgccgtcgtcggcctcggggggctcggtcacatggccgtgaagctcgcgaaggcgatgggggcgaaggtcaccgtgctctcccagtccctgcggaaaaaggaggacggcctgcgcctcggcgcgaaagcctactacgcgacgagcgatcccgagacattccgccagctcgccggacgcttcgatctcatcatcaacacggtgtcggcgaagatccccatcactgagtatctgggccttctgaagacggatggcgctctggtcaacgtcggcgcgccgccggagccgctcgaggtgaacgcgtttgcgctcatcgcacagcgccgcacgtttgcgggctcctgcatcggcggcatccgcgagacgcaggagatgctcgatttctgcgctgagagcggtgtgacgcccgagatcgaggtcatctcggcggacgagatcgacgcggcgtgggagcgggtgctgaagtcggacgtgcggtatcgattcgtgatcgacttaagcacgatgcgcaattga

SEQ ID NO: 579 - protein, 357 aa, Alicyclobacillus acidocaldarius
MERERGQAVKAARMVGFREPLVIERVPDPTPGPEDAVIRVEASGICRSDWHGWMGDWTWLGLSPQLPITPGHEFGGEIVALGREVRDFQIGDKVTVPFHYACGHCEHCHAGVPNRCDHVGIYGFSWDGSFAEYVVVRNANMNLIRLPEGVDALTAAAVGCRFMTGYHGVMRGGVRPGQWVAVHGAGGVGLSAIQTAYAVGARVIAVDVDDEKLAKAREEGACEVVNAKNQPVVEAIREITKGGAHVSIDALGIRDTVLNSVLSLRKGGRHVQIGLTTSQEGGFVPLPMDLITSCEIEVVGSLGIPHPDYAGLLALVAEGRLRPRNLVEREVRLEDVNEVFDKMTRFETRGFNMITAF

SEQ ID NO: 580 - DNA, 1074 bp, Alicyclobacillus acidocaldarius
gtggaaagggagcgtggacaagccgtgaaagcagcgagaatggtgggatttcgcgagccgctcgtcatcgagcgcgtgccggatccgacacccgggccggaggacgccgtgatccgggtggaggcgagcggcatctgtcggagcgactggcatggatggatgggggactggacctggctcgggctttcgccgcagttgcccatcacccccggtcacgaattcggtggcgagatcgtcgcattggggcgggaggtgcgagactttcaaatcggcgacaaggtgacggtgccgtttcactacgcctgcggacactgtgaacactgccacgcgggcgtgccgaaccggtgtgatcacgtcggcatctacggcttcagttgggacggcagcttcgcggaatatgtggtcgttcgaaacgcgaatatgaacctgattcgcctgccggaaggcgtcgacgcccttacggcagccgccgtagggtgccggtttatgaccgggtatcacggcgtgatgcggggaggcgtgaggcccggacagtgggtggcggtgcacggcgcaggtggcgtgggcctctcggccattcagacggcgtacgccgtgggcgcgcgcgtgattgcggtcgatgtggacgacgagaagctggccaaagcgcgcgaggaaggcgcgtgtgaggttgtgaacgcaaaaaaccagcccgtggtggaggccatccgggagatcaccaagggcggggcccacgtgagcatcgatgcgttgggcattcgggacacggtcctgaactccgtattgagccttcgcaagggaggcaggcacgtgcagattggtctcaccacgtcccaagagggtgggtttgtgccgcttcccatggatctcatcacgagttgcgagattgaggtcgtggggagcctcggcattccgcacccggactacgcggggctcctcgcgttggttgccgaaggtcgcctgaggccgagaaacctggtggagcgagaggtccgactcgaagatgtcaacgaggtgttcgacaaaatgacgcggtttgaaaccagaggtttcaacatgatcacggcgttctga

SEQ ID NO: 581 - protein, 351 aa, Streptomyces refuineus subsp. thermotolerans
VRAAQIVGYGEPLQVREVPDPAPEPGGVVVAVLATGICRSDWHGWRGDWEWLGGRIALPRTPGHEIAGEVVAAGPGVRGVRVGDRVTVPFHLACGTCAHCRAGQANLCDEMEVLGFWRDGGYAEYVRIPHADFNCVRIPDGVTPLTASAIGCRFMTAFHAVDGQGRVRPGEWVAVHGVGGVGLSCVQIASAAGASVVAVDIDPAKLALAEQQGAAHTVDAGAEQDVPAAVREVTGGGAHVSIDALGIRTTVVNSVRSLRKRGRHVQVGLTGAEDAGEIALPIDLITLGELTVVGSHGNPHAAYPRLLSLIESGRLAPQTLVQRTVSLDQAGDVLAAMDAFATSGLTVIDRF

SEQ ID NO: 582 - protein, 349 aa, Propionibacterium acnes KPA171202
MKAALVEQYHEPLAIRDIPEPAHDSDGVVVEVKACGVCRSDWHGWQGEWPGFTGGSLPHIFGHEFVGLVSDIGNNVSRYRVGDRVIVPFTLGCGHCEYCRSGHSNVCPTVSMPGFSYDGGFAQYVTVPDADANLVKLPDAVDFTDAAGMGCRLMTAYHGIVEVGQIHPGDWLVVYGAGGVGLSATLVATSAGANVIAVDIADDKLALARKVGAIATINSRETDPVEAVRELTDGGADKSVDALGISETLHNAVNSLRSRGTHIQIGMTAEGPVGDVALTINDLIAKEIDFRGSFGMPAVEFRYLLNQVAAGKMKPGQLVTKTIALSEVNDALTAMSTYNTVGTTVITDF

SEQ ID NO: 583 - protein, 346 aa, Silicibacter sp. TM1040
MKAVLYETFKELPKLVTVEDPTPDPDGVVIKVEATGLCRSDWHGWMGHDSDIVLPHVPGHEFAGVIVALGKNVRNWTVGDRVTVPFISGCGACSECHAGHQQVCHNQQQPGFTHWGSFAEYVGVRQADLNLVALPQEMDFATAASLGCRFATSFRAVVDQAQTRAGQWVAVHGCGGVGLSAVMIAQAVGANVIAIDIDDEKLNLAQELGAVATINGARVADVPEAVIDLSRGGAHVSLDALGHPLTCFNSIQNLRPRGKHVQVGLMLAEHSTPSVPMAKVIAKELEILGSHGMQAHRYDAMLDMIASGKLDPRRLVGREISLDAAPSALVKMDQFQSIGATVITTF

SEQ ID NO: 584 - protein, 353 aa, Haloarcula marismortui ATCC 43049
MRAAVLEEYEEPLAIRDVERPDPDPDGVVAKVDACGVCRSDWHGWVGNWDWFDYKPPRGHILGHEPSGTVVEVGENVDTVKEGDTVAIPFNFACGHCHECRVGYENLCENHLGLGFQPGAPGAFAEEVPIPNADINAVKLPDGVDPVEVAGMGCRFMTSYRGMAHQADVSRGEYVVVQGLGGIGLSAVHIADALGGNVIGVDLMDEKLEMAEELGAIDTVNAAEEDDVVQAVRDITDGGAHVSLDALGIEETCQNAIESLRTRGRHVQIGLTTKEQRGYNSLPTDTIVMNEIQVQGSSGLPPSKYGEMFRMVENGKLDPGAVITDKIGLEGVSDELAAMTDYETIGIPVVNEF

SEQ ID NO: 585 - protein, 345 aa, Roseovarius sp. HTCC2601
MKAVLFETFQEAPKLVTVPDPVPDAHGVVLKVAATGVCRSDWHGWMGHDSDIELPHVPGHELAGEVAAVGKDVRNWKIGDKVTVPFICGCGSCSECHAGQQQVCLHQEQPGFTHWGSFAEYVPIHQADLNLVALPEGMGFDTAASLGCRFATSFRAVIDQGKVRAGQWVAVHGCGGVGLSAVMIAAAAGANVIGVDLDPVKLALAKEIGAVAAIDGHEADVPGAIREITRGGAHVSLDALGHPVTMTNSILCLRPRGKHVQVGLMLGEHAAPQVPMPKIVGQEIELLGSHGMQAHRYGAMLDMVASGKLDPARLVGERISLAEAPAALMAMDSFRSVGATVITRF

SEQ ID NO: 586 - protein, 357 aa, Artificial
  Substituion in SEQ ID NO 579
MERERGQAVKAARMVGFREPLVIERVPDPTPGPEDAVIRVEASGICRSDWHGWMGDWTWLGLSPQLPITPGHEFGGEIVALGREVRDFQLGDKVTVPFHYACGHCEHCHAGVPNRCDHVGIYGFSWDGSFAEYVVVRNANMNLIRLPEGVDALTAAAVGCRFMTGYHGVMRGGVRPGQWVAVHGAGGVGLSAIQTAYAVGARVIAVDVDDEKLAKAREEGACEVVNAKNQPVVEAIREITKGGAHVSIDALGIRDTVLNSVLSLRKGGRHVQIGLTTSQEGGFVPLPMDLITSCEIEVVGSLGIPHPDYAGLLALVAEGRLRPRNLVEREVRLEDVNEVFDKMTRFETRGFNMITAF

SEQ ID NO: 587 - protein, 357 aa, Artificial
  Substituion in SEQ ID NO 579
MERERGQAVKAARMVGFREPLVIERVPDPTPGPEDAVIRVEASGICRSDWHGWMGDWTWLGLSPQLPITPGHEFGGEIVALGREVRDFQIGDKVTVPFHYACGHCEHCHAGVPNRCDHVGIYGFSWDGSFAEYVVVRNANMNLIRLPEGVDALTAAAVGCRFMTGYHGVMRGGVRPGQWVAVHGAGGVGLSAIQTAYAVGARVIAVDVDDEKLAKAREEGACEVVNAKNQPVVEAIREITKGGAHVSIDALGIRDTVLNSVLSLRKGGRHVQIGLTTSQDGGFVPLPMDLITSCEIEVVGSLGIPHPDYAGLLALVAEGRLRPRNLVEREVRLEDVNEVFDKMTRFETRGFNMITAF

SEQ ID NO: 588 - protein, 357 aa, Artificial
  Substituion in SEQ ID NO 579
MERERGQAVKAARMVGFREPLVIERVPDPTPGPEDAVIRVEASGICRSDWHGWMGDWTWLGLSPQIPITPGHEFGGEIVALGREVRDFQIGDKVTVPFHYACGHCEHCHAGVPNRCDHVGIYGFSWDGSFAEYVVVRNANMNLIRLPEGVDALTAAAVGCRFMTGYHGVMRGGVRPGQWVAVHGAGGVGLSAIQTAYAVGARVIAVDVDDEKLAKAREEGACEVVNAKNQPVVEAIREITKGGAHVSIDALGIRDTVLNSVLSLRKGGRHVQIGLTTSQEGGFVPLPMDLITSCEIEVVGSLGIPHPDYAGLLALVAEGRLRPRNLVEREVRLEDVNEVFDKMTRFETRGFNMITAF

SEQ ID NO: 589 - protein, 357 aa, Artificial
  Substituion in SEQ ID NO 579
MERERGQAVKAARMVGFREPLVIERVPDPTPGPEDAVIRVEASGICRSDWHGWMGDWTWLGLSPQLPITPGHEFGGEIVALGREVRDFQIGDKVTVPFHYACGHCEHCHAGVPNRCDHVGIYGFSWDGSFAEYVVVRNANMNLIRLPEGVDALTAAAVGCRFMTGYHGVMRGGVRPGQWVAVHGAGGVGLSAIQTAYAVGARVIAVDVDDEKLAKAREEGACEVVNAKNQPVVEAIREITKGGAHVSIDALGIRDTVLNSVLSLRKGGRHVQIGLTTSQEGGFVPLPMDLITSCEIEVVGSLGIPHPDYAGLLALVAEGRLRPRNLVEREVRLEDVQEVFDKMTRFETRGFNMITAF

SEQ ID NO: 590 - protein, 357 aa, Artificial
  Substituion in SEQ ID NO 579
MERERGQAVKAARMVGFREPLVIERVPDPTPGPEDAVIRVEASGICRSDWHGWMGDWTWLGLSPQLPITPGHEFGGEIVALGRDVRDFQIGDKVTVPFHYACGHCEHCHAGVPNRCDHVGIYGFSWDGSFAEYVVVRNANMNLIRLPEGVDALTAAAVGCRFMTGYHGVMRGGVRPGQWVAVHGAGGVGLSAIQTAYAVGARVIAVDVDDEKLAKAREEGACEVVNAKNQPVVEAIREITKGGAHVSIDALGIRDTVLNSVLSLRKGGRHVQIGLTTSQEGGFVPLPMDLITSCEIEVVGSLGIPHPDYAGLLALVAEGRLRPRNLVEREVRLEDVNEVFDKMTRFETRGFNMITAF

SEQ ID NO: 591 - DNA, 1074 bp, Artificial
  Substituion in SEQ ID NO 580
gtggaaagggagcgtggacaagccgtgaaagcagcgagaatggtgggatttcgcgagccgctcgtcatcgagcgcgtgccggatccgacacccgggccggaggacgccgtgatccgggtggaggcgagcggcatctgtcggagcgactggcatggatggatgggggactggacctggctcgggctttcgccgcagttgcccatcacccccggtcacgaattcggtggcgagatcgtcgcattggggcgggaggtgcgagactttcaattaggcgacaaggtgacggtgccgtttcactacgcctgcggacactgtgaacactgccacgcgggcgtgccgaaccggtgtgatcacgtcggcatctacggcttcagttgggacggcagcttcgcggaatatgtggtcgttcgaaacgcgaatatgaacctgattcgcctgccggaaggcgtcgacgcccttacggcagccgccgtagggtgccggtttatgaccgggtatcacggcgtgatgcggggaggcgtgaggcccggacagtgggtggcggtgcacggcgcaggtggcgtgggcctctcggccattcagacggcgtacgccgtgggcgcgcgcgtgattgcggtcgatgtggacgacgagaagctggccaaagcgcgcgaggaaggcgcgtgtgaggttgtgaacgcaaaaaaccagcccgtggtggaggccatccgggagatcaccaagggcggggcccacgtgagcatcgatgcgttgggcattcgggacacggtcctgaactccgtattgagccttcgcaagggaggcaggcacgtgcagattggtctcaccacgtcccaagagggtgggtttgtgccgcttcccatggatctcatcacgagttgcgagattgaggtcgtggggagcctcggcattccgcacccggactacgcggggctcctcgcgttggttgccgaaggtcgcctgaggccgagaaacctggtggagcgagaggtccgactcgaagatgtcaacgaggtgttcgacaaaatgacgcggtttgaaaccagaggtttcaacatgatcacggcgttctga

SEQ ID NO: 592 - DNA, 1074 bp, Artificial
  Substituion in SEQ ID NO 580
gtggaaagggagcgtggacaagccgtgaaagcagcgagaatggtgggatttcgcgagccgctcgtcatcgagcgcgtgccggatccgacacccgggccggaggacgccgtgatccgggtggaggcgagcggcatctgtcggagcgactggcatggatggatgggggactggacctggctcgggctttcgccgcagttgcccatcacccccggtcacgaattcggtggcgagatcgtcgcattggggcgggaggtgcgagactttcaaatcggcgacaaggtgacggtgccgtttcactacgcctgcggacactgtgaacactgccacgcgggcgtgccgaaccggtgtgatcacgtcggcatctacggcttcagttgggacggcagcttcgcggaatatgtggtcgttcgaaacgcgaatatgaacctgattcgcctgccggaaggcgtcgacgcccttacggcagccgccgtagggtgccggtttatgaccgggtatcacggcgtgatgcggggaggcgtgaggcccggacagtgggtggcggtgcacggcgcaggtggcgtgggcctctcggccattcagacggcgtacgccgtgggcgcgcgcgtgattgcggtcgatgtggacgacgagaagctggccaaagcgcgcgaggaaggcgcgtgtgaggttgtgaacgcaaaaaaccagcccgtggtggaggccatccgggagatcaccaagggcggggcccacgtgagcatcgatgcgttgggcattcgggacacggtcctgaactccgtattgagccttcgcaagggaggcaggcacgtgcagattggtctcaccacgtcccaagatggtgggtttgtgccgcttcccatggatctcatcacgagttgcgagattgaggtcgtggggagcctcggcattccgcacccggactacgcggggctcctcgcgttggttgccgaaggtcgcctgaggccgagaaacctggtggagcgagaggtccgactcgaagatgtcaacgaggtgttcgacaaaatgacgcggtttgaaaccagaggtttcaacatgatcacggcgttctga

SEQ ID NO: 593 - DNA, 1074 bp, Artificial
  Substituion in SEQ ID NO 580
gtggaaagggagcgtggacaagccgtgaaagcagcgagaatggtgggatttcgcgagccgctcgtcatcgagcgcgtgccggatccgacacccgggccggaggacgccgtgatccgggtggaggcgagcggcatctgtcggagcgactggcatggatggatgggggactggacctggctcgggctttcgccgcagattcccatcacccccggtcacgaattcggtggcgagatcgtcgcattggggcgggaggtgcgagactttcaaatcggcgacaaggtgacggtgccgtttcactacgcctgcggacactgtgaacactgccacgcgggcgtgccgaaccggtgtgatcacgtcggcatctacggcttcagttgggacggcagcttcgcggaatatgtggtcgttcgaaacgcgaatatgaacctgattcgcctgccggaaggcgtcgacgcccttacggcagccgccgtagggtgccggtttatgaccgggtatcacggcgtgatgcggggaggcgtgaggcccggacagtgggtggcggtgcacggcgcaggtggcgtgggcctctcggccattcagacggcgtacgccgtgggcgcgcgcgtgattgcggtcgatgtggacgacgagaagctggccaaagcgcgcgaggaaggcgcgtgtgaggttgtgaacgcaaaaaaccagcccgtggtggaggccatccgggagatcaccaagggcggggcccacgtgagcatcgatgcgttgggcattcgggacacggtcctgaactccgtattgagccttcgcaagggaggcaggcacgtgcagattggtctcaccacgtcccaagagggtgggtttgtgccgcttcccatggatctcatcacgagttgcgagattgaggtcgtggggagcctcggcattccgcacccggactacgcggggctcctcgcgttggttgccgaaggtcgcctgaggccgagaaacctggtggagcgagaggtccgactcgaagatgtcaacgaggtgttcgacaaaatgacgcggtttgaaaccagaggtttcaacatgatcacggcgttctga

SEQ ID NO: 594 - DNA, 1074 bp, Artificial
  Substituion in SEQ ID NO 580
gtggaaagggagcgtggacaagccgtgaaagcagcgagaatggtgggatttcgcgagccgctcgtcatcgagcgcgtgccggatccgacacccgggccggaggacgccgtgatccgggtggaggcgagcggcatctgtcggagcgactggcatggatggatgggggactggacctggctcgggctttcgccgcagttgcccatcacccccggtcacgaattcggtggcgagatcgtcgcattggggcgggaggtgcgagactttcaaatcggcgacaaggtgacggtgccgtttcactacgcctgcggacactgtgaacactgccacgcgggcgtgccgaaccggtgtgatcacgtcggcatctacggcttcagttgggacggcagcttcgcggaatatgtggtcgttcgaaacgcgaatatgaacctgattcgcctgccggaaggcgtcgacgcccttacggcagccgccgtagggtgccggtttatgaccgggtatcacggcgtgatgcggggaggcgtgaggcccggacagtgggtggcggtgcacggcgcaggtggcgtgggcctctcggccattcagacggcgtacgccgtgggcgcgcgcgtgattgcggtcgatgtggacgacgagaagctggccaaagcgcgcgaggaaggcgcgtgtgaggttgtgaacgcaaaaaaccagcccgtggtggaggccatccgggagatcaccaagggcggggcccacgtgagcatcgatgcgttgggcattcgggacacggtcctgaactccgtattgagccttcgcaagggaggcaggcacgtgcagattggtctcaccacgtcccaagagggtgggtttgtgccgcttcccatggatctcatcacgagttgcgagattgaggtcgtggggagcctcggcattccgcacccggactacgcggggctcctcgcgttggttgccgaaggtcgcctgaggccgagaaacctggtggagcgagaggtccgactcgaagatgtccaagaggtgttcgacaaaatgacgcggtttgaaaccagaggtttcaacatgatcacggcgttctga

SEQ ID NO: 595 - DNA, 1074 bp, Artificial
  Substituion in SEQ ID NO 580
gtggaaagggagcgtggacaagccgtgaaagcagcgagaatggtgggatttcgcgagccgctcgtcatcgagcgcgtgccggatccgacacccgggccggaggacgccgtgatccgggtggaggcgagcggcatctgtcggagcgactggcatggatggatgggggactggacctggctcgggctttcgccgcagttgcccatcacccccggtcacgaattcggtggcgagatcgtcgcattggggcgggatgtgcgagactttcaaatcggcgacaaggtgacggtgccgtttcactacgcctgcggacactgtgaacactgccacgcgggcgtgccgaaccggtgtgatcacgtcggcatctacggcttcagttgggacggcagcttcgcggaatatgtggtcgttcgaaacgcgaatatgaacctgattcgcctgccggaaggcgtcgacgcccttacggcagccgccgtagggtgccggtttatgaccgggtatcacggcgtgatgcggggaggcgtgaggcccggacagtgggtggcggtgcacggcgcaggtggcgtgggcctctcggccattcagacggcgtacgccgtgggcgcgcgcgtgattgcggtcgatgtggacgacgagaagctggccaaagcgcgcgaggaaggcgcgtgtgaggttgtgaacgcaaaaaaccagcccgtggtggaggccatccgggagatcaccaagggcggggcccacgtgagcatcgatgcgttgggcattcgggacacggtcctgaactccgtattgagccttcgcaagggaggcaggcacgtgcagattggtctcaccacgtcccaagagggtgggtttgtgccgcttcccatggatctcatcacgagttgcgagattgaggtcgtggggagcctcggcattccgcacccggactacgcggggctcctcgcgttggttgccgaaggtcgcctgaggccgagaaacctggtggagcgagaggtccgactcgaagatgtcaacgaggtgttcgacaaaatgacgcggtttgaaaccagaggtttcaacatgatcacggcgttctga

SEQ ID NO: 596 - protein, 232 aa, Alicyclobacillus acidocaldarius
MRSLPLLKICGLRPGDDLSFLRHPAVTHVGVVMVPASRRYVSPDEAGDLVRTAKRLRPDVTTVAVVSGGSREEIGEGARRAGVDVVQLHGGEPRDVAERLREAGFRVWRAVAFDPGDDVTSFLDTLRSHASSADAILFDAKPPSDAKPGVTGGHGRAFDWDRLAEMARAFSFDWWVAGGITPENVRDLLRRVRPVGIDVSSGVEVGGRKDVRRIDQLIQAMEAWGHESLSLS

SEQ ID NO: 597 - DNA, 699 bp, Alicyclobacillus acidocaldarius
gtgagaagcctcccgcttttgaaaatctgcggacttcggccgggcgacgatctgtcgtttcttcgccatcccgccgtcacgcatgtgggcgtcgtgatggtcccggcgtccaggcgctacgtgtccccggacgaggcgggcgatctcgtccgaaccgcgaagcgcctccgcccggatgtgaccaccgttgcggtggtctcaggcggatcgcgcgaagagatcggggagggtgcgaggagggccggcgtcgacgtggtgcagttgcacggaggtgaacctcgggacgtcgcggagaggcttcgcgaagctgggtttcgggtgtggcgcgcggtcgcgttcgatcccggagacgatgtgacttcttttctggataccttgaggtcgcatgcgtcttccgccgacgccatcctgttcgatgcgaaaccgccatcggacgcgaaacccggcgtcacgggcgggcacggtcgagcgttcgactgggatcgcttggccgagatggcgcgggcgttcagcttcgattggtgggtcgcgggcggaatcacgccggaaaacgttcgggacctcctgcgccgggtgcggccagtcggcatcgacgtgtcttcgggcgtggaagtcggcgggcggaaggacgtccgccgcattgatcagttgattcaggcgatggaggcgtggggccatgagtcattatccttatcctga

SEQ ID NO: 598 - protein, 203 aa, Paracoccus denitrificans PD1222
VKICGLTEAAGLAAAVDAGARYVGFVFFPKSPRHVTPGTAAELAAQVPLGVAKVGLFVNPDDAALDAVLAHVPLDVIQLHGAETPARVAEVKARTGLPVMKAVGVADPQDLDALWDYGLVADMLLIDAKPPKDAVLPGGNGLAFDWRLLAGRQILKPWLLAGGLTPENVHEAIRLTRAPGVDVSSGVESAPGVKDPDRIRSFI

SEQ ID NO: 599 - protein, 203 aa, Paracoccus denitrificans PD1222; identical to SEQ ID NO: 598

SEQ ID NO: 600 - protein, 215 aa, Brucella ovis ATCC 25840
MRRKPMALDIKICGLKTPEAVAAALDGGATHIGFIFFPKSPRHITPDAAARLRAAATGRAVTVAVTVDADDEALDEIVKTVRPDMLQLHGGETPERVRFLKERYNLPVMKAFSIREAGDLEAIAPYRGIADRFLFDAKPPKGSELPGGNGISFDWNLLAALDADIDYMLSGGLNADNIAEALLKTGAPGIDISSGVECAPGEKDVRLIENFFQAV

SEQ ID NO: 601 - protein, 208 aa, Mesorhizobium loti MAFF303099
IKICGLKTDQAMAAALGGGASHVGFIFFAKSPRYVEPAEAGRLREAARGKAVAVAVTVDATDAFLDEIVSAMQPDMLQLHGSEHPERVAELKARYGLPVMKALPLSEAADLDRIRPFIGIADRFLFDAKPPKGSELPGGNGVAFDWRILAGLDAGVDYMLSGGLNAANIGDALRLANPPGIDISSGVESAPGVKDPALIEQFFRAVRA

SEQ ID NO: 602 - protein, 206 aa, Oceanicola batsensis HTCC2597
VKICGLSRPEDVAAAARAGAVYGGFVFFPKSPRHVSVESARELAIAAPPGLAKVALIVDADDDLIDRITATVPLDMLQLHGTESPDRVAEVRARTGLPVMKAVGLSEAADLAAIDLYSEVADQLLIDAKPPKEASIPGGNGLAFDWRLLQQRKYWSRPWMLAGGLTPDNVAEAIRLTGARQVDVSSGVEAGRGIKDPERIAGFVAA

SEQ ID NO: 603 - protein, 232 aa, Artificial
  Substituion in SEQ ID NO 596
MRSLPLLKICGLRPGDDLSFLRHPAVTHVGVVMVPASRRYVSPDEAGDLVRTAKRLRPDVTTVAVVSGGSREEIGEGARRAGVDVVQLHGGEPRDVAERLREAGFRVWRAVAFDPGDDVTSFLDTLRSHASSADAILFDAKPPSDAKPGVTGGHGKAFDWDRLAEMARAFSFDWWVAGGITPENVRDLLRRVRPVGIDVSSGVEVGGRKDVRRIDQLIQAMEAWGHESLSLS

SEQ ID NO: 604 - protein, 232 aa, Artificial
  Substituion in SEQ ID NO 596
MRSLPLLKICGLRPGDDLSFLRHPAVTHVGVVMVPASRRYVSPDEAGDLVRTAKRLRPDVTTVAVVSGGSREEIGEGARRAGVDVVQLHGGEPRDVAERLREAGFRVWRAVAFDPGDDVTSFLDTLRSHASSADAILFDAKPPSDAKPGVTGGHGRAFDWDRLAEMARAFSFDWWVAGGITPENVRDLLRRVRPVGIDVSSGVEVGGRKDVRRIDQLIQAMDAWGHESLSLS

SEQ ID NO: 605 - protein, 232 aa, Artificial
  Substituion in SEQ ID NO 596
MRSLPLLKICGLRPGDDLSFLRHPAVTHVGVVMVPASRRYVSPDEAGDLVRTAKRLRPDVTTVAVVSGGSREEIGEGARRAGVDVVQLHGGEPREVAERLREAGFRVWRAVAFDPGDDVTSFLDTLRSHASSADAILFDAKPPSDAKPGVTGGHGRAFDWDRLAEMARAFSFDWWVAGGITPENVRDLLRRVRPVGIDVSSGVEVGGRKDVRRIDQLIQAMEAWGHESLSLS

SEQ ID NO: 606 - protein, 232 aa, Artificial
  Substituion in SEQ ID NO 596
MRSLPLLKICGLRPGDDLSFLRHPAVTHVGVVMVPASRRYVSPDEAGDLVRTAKRLRPDVTTVAVVSGGSREEIGEGARRAGVDVVQLHGGEPRDVAERLREAGFRVWRAVAFDPGDDVTSFLDTLRSHASSADAILFDAKPPSDAKPGVTGGHGRAFDWDRLAEMARAFSFDWWVAGGITPENVKDLLRRVRPVGIDVSSGVEVGGRKDVRRIDQLIQAMEAWGHESLSLS

SEQ ID NO: 607 - protein, 232 aa, Artificial
  Substituion in SEQ ID NO 596
MRSLPLLKICGLRPGDDLSFLRHPAVTHVGVVMVPASRRYVSPDEAGDLVRTAKRLRPDVTTVAVVSGGSREEIGDGARRAGVDVVQLHGGEPRDVAERLREAGFRVWRAVAFDPGDDVTSFLDTLRSHASSADAILFDAKPPSDAKPGVTGGHGRAFDWDRLAEMARAFSFDWWVAGGITPENVRDLLRRVRPVGIDVSSGVEVGGRKDVRRIDQLIQAMEAWGHESLSLS

SEQ ID NO: 608 - DNA, 699 bp, Artificial
  Substituion in SEQ ID NO 597
gtgagaagcctcccgcttttgaaaatctgcggacttcggccgggcgacgatctgtcgtttcttcgccatcccgccgtcacgcatgtgggcgtcgtgatggtcccggcgtccaggcgctacgtgtccccggacgaggcgggcgatctcgtccgaaccgcgaagcgcctccgcccggatgtgaccaccgttgcggtggtctcaggcggatcgcgcgaagagatcggggagggtgcgaggagggccggcgtcgacgtggtgcagttgcacggaggtgaacctcgggacgtcgcggagaggcttcgcgaagctgggtttcgggtgtggcgcgcggtcgcgttcgatcccggagacgatgtgacttcttttctggataccttgaggtcgcatgcgtcttccgccgacgccatcctgttcgatgcgaaaccgccatcggacgcgaaacccggcgtcacgggcgggcacggtaaagcgttcgactgggatcgcttggccgagatggcgcgggcgttcagcttcgattggtgggtcgcgggcggaatcacgccggaaaacgttcgggacctcctgcgccgggtgcggccagtcggcatcgacgtgtcttcgggcgtggaagtcggcgggcggaaggacgtccgccgcattgatcagttgattcaggcgatggaggcgtggggccatgagtcattatccttatcctga

SEQ ID NO: 609 - DNA, 699 bp, Artificial
  Substituion in SEQ ID NO 597
gtgagaagcctcccgcttttgaaaatctgcggacttcggccgggcgacgatctgtcgtttcttcgccatcccgccgtcacgcatgtgggcgtcgtgatggtcccggcgtccaggcgctacgtgtccccggacgaggcgggcgatctcgtccgaaccgcgaagcgcctccgcccggatgtgaccaccgttgcggtggtctcaggcggatcgcgcgaagagatcggggagggtgcgaggagggccggcgtcgacgtggtgcagttgcacggaggtgaacctcgggacgtcgcggagaggcttcgcgaagctgggtttcgggtgtggcgcgcggtcgcgttcgatcccggagacgatgtgacttcttttctggataccttgaggtcgcatgcgtcttccgccgacgccatcctgttcgatgcgaaaccgccatcggacgcgaaacccggcgtcacgggcgggcacggtcgagcgttcgactgggatcgcttggccgagatggcgcgggcgttcagcttcgattggtgggtcgcgggcggaatcacgccggaaaacgttcgggacctcctgcgccgggtgcggccagtcggcatcgacgtgtcttcgggcgtggaagtcggcgggcggaaggacgtccgccgcattgatcagttgattcaggcgatggatgcgtggggccatgagtcattatccttatcctga

SEQ ID NO: 610 - DNA, 699 bp, Artificial
  Substituion in SEQ ID NO 597
gtgagaagcctcccgcttttgaaaatctgcggacttcggccgggcgacgatctgtcgtttcttcgccatcccgccgtcacgcatgtgggcgtcgtgatggtcccggcgtccaggcgctacgtgtccccggacgaggcgggcgatctcgtccgaaccgcgaagcgcctccgcccggatgtgaccaccgttgcggtggtctcaggcggatcgcgcgaagagatcggggagggtgcgaggagggccggcgtcgacgtggtgcagttgcacggaggtgaacctcgggaagtcgcggagaggcttcgcgaagctgggtttcgggtgtggcgcgcggtcgcgttcgatcccggagacgatgtgacttcttttctggataccttgaggtcgcatgcgtcttccgccgacgccatcctgttcgatgcgaaaccgccatcggacgcgaaacccggcgtcacgggcgggcacggtcgagcgttcgactgggatcgcttggccgagatggcgcgggcgttcagcttcgattggtgggtcgcgggcggaatcacgccggaaaacgttcgggacctcctgcgccgggtgcggccagtcggcatcgacgtgtcttcgggcgtggaagtcggcgggcggaaggacgtccgccgcattgatcagttgattcaggcgatggaggcgtggggccatgagtcattatccttatcctga

SEQ ID NO: 611 - DNA, 699 bp, Artificial
  Substituion in SEQ ID NO 597
gtgagaagcctcccgcttttgaaaatctgcggacttcggccgggcgacgatctgtcgtttcttcgccatcccgccgtcacgcatgtgggcgtcgtgatggtcccggcgtccaggcgctacgtgtccccggacgaggcgggcgatctcgtccgaaccgcgaagcgcctccgcccggatgtgaccaccgttgcggtggtctcaggcggatcgcgcgaagagatcggggagggtgcgaggagggccggcgtcgacgtggtgcagttgcacggaggtgaacctcgggacgtcgcggagaggcttcgcgaagctgggtttcgggtgtggcgcgcggtcgcgttcgatcccggagacgatgtgacttcttttctggataccttgaggtcgcatgcgtcttccgccgacgccatcctgttcgatgcgaaaccgccatcggacgcgaaacccggcgtcacgggcgggcacggtcgagcgttcgactgggatcgcttggccgagatggcgcgggcgttcagcttcgattggtgggtcgcgggcggaatcacgccggaaaacgttaaagacctcctgcgccgggtgcggccagtcggcatcgacgtgtcttcgggcgtggaagtcggcgggcggaaggacgtccgccgcattgatcagttgattcaggcgatggaggcgtggggccatgagtcattatccttatcctga

SEQ ID NO: 612 - DNA, 699 bp, Artificial
  Substituion in SEQ ID NO 597
gtgagaagcctcccgcttttgaaaatctgcggacttcggccgggcgacgatctgtcgtttcttcgccatcccgccgtcacgcatgtgggcgtcgtgatggtcccggcgtccaggcgctacgtgtccccggacgaggcgggcgatctcgtccgaaccgcgaagcgcctccgcccggatgtgaccaccgttgcggtggtctcaggcggatcgcgcgaagagatcggggatggtgcgaggagggccggcgtcgacgtggtgcagttgcacggaggtgaacctcgggacgtcgcggagaggcttcgcgaagctgggtttcgggtgtggcgcgcggtcgcgttcgatcccggagacgatgtgacttcttttctggataccttgaggtcgcatgcgtcttccgccgacgccatcctgttcgatgcgaaaccgccatcggacgcgaaacccggcgtcacgggcgggcacggtcgagcgttcgactgggatcgcttggccgagatggcgcgggcgttcagcttcgattggtgggtcgcgggcggaatcacgccggaaaacgttcgggacctcctgcgccgggtgcggccagtcggcatcgacgtgtcttcgggcgtggaagtcggcgggcggaaggacgtccgccgcattgatcagttgattcaggcgatggaggcgtggggccatgagtcattatccttatcctga

SEQ ID NO: 613 - protein, 497 aa, Alicyclobacillus acidocaldarius
MAVQEVNASALHPDVVEFLKGPKGLFIDGEFVPSLSGKTFKSINPATEEVLVEVAEAEAPDIDRAVKAARRAFESGPWSRMSAAERSRLLYRLADLMEEHKLQLAQLETLDNGKPIRESLNADLPLAIEHIRYYAGWPTKVVGQTIPVAGKYFNYTRHEPVGVVGQIIPWNFPLLMACWKIGAALAMGCTVVLKPAEQTPLSALYLAKLIQEAGFPPGVVNVVPGFGETAGQALVEHPDVNKIAFTGSTEVGKLIMRNAAATLKRVTLELGGKSPNIILPDADMSRAIPGAFMGIMFNQGQVCCAGSRLFVQKKAYDNVVADLVSLAKKIRQGPGLDQGTEMGPLVSDEQEKRVLGYIEKGVEEGAEVLVGGGKATDRGYFVQPTIFANVRDDMTIAREEIFGPVVAAMPFEDLDEVIARANDTEYGLAAGVWTENIRNAHYIASKLKAGTVWVNCYNVFDAAAPFGGYKQSGIGREMGSYALNNYTEVKDVWISLS

SEQ ID NO: 614 - DNA, 1494 bp, Alicyclobacillus acidocaldarius
gtggcagttcaagaagtgaatgcgagcgctctgcatccggatgtcgtcgagtttctcaagggtcccaagggcctgttcattgacggcgaattcgttccctcactctccggcaaaacgttcaagtctatcaaccctgcgacagaagaagtcctggtggaagtcgcggaggcggaagctcccgacattgaccgcgcggtcaaagccgctcgccgcgcctttgagtccggcccgtggtcgcgcatgagcgccgcggagcggtcccggcttctctataggctggcggatctcatggaagaacataagctgcagctcgctcagctcgaaaccctcgacaacggcaaacccattcgcgaatccctgaacgcagacctgccgcttgccatcgaacacattcgctactacgccggctggcccaccaaggtcgtggggcaaaccattccggtagcgggaaaatacttcaactacacgcgacacgagcccgtcggcgtcgtgggccagatcatcccgtggaacttcccgctcctcatggcgtgctggaagattggcgccgcgctggccatgggctgcacggtggtgctcaagccggcggagcagacgccgctctccgcgctctacctggccaaactgatccaagaggctggcttcccgccgggcgtcgtcaatgtcgtgccgggcttcggcgagaccgccggacaggcactggtggagcacccggacgtcaacaagattgcgttcaccggatcgacggaggtcggcaagctcatcatgcgcaacgccgcggcgaccttgaagcgcgtcacgctcgagctcggcggcaagtccccgaacatcattctccccgatgccgacatgagccgagccatccccggcgcgttcatgggcatcatgttcaaccagggccaggtgtgctgcgccggatcgcgcctgttcgtgcagaagaaagcgtacgacaacgtggtggccgatctcgtctccctcgcgaagaagatccgccaaggcccgggcttggatcaaggcacggagatggggccgctcgtgtccgatgaacaggagaagcgcgtgctgggctacatcgagaagggcgtggaagagggcgccgaggtcctcgtcggcggcggcaaggccacggatcgcggatacttcgtgcagccgaccatcttcgccaatgtccgggacgacatgaccatcgcgcgcgaggagatcttcggaccggtggtcgcggcgatgccgtttgaagatttggacgaagtcattgcgcgcgcgaacgacacggagtacggcctggcggccggtgtgtggacggagaacatccggaatgcccactatatcgccagcaagctgaaggccggcactgtttgggtcaactgctacaacgtgtttgacgcggcggctcccttcggtggatacaagcagtccggtatcgggcgcgaaatgggctcgtacgcgttgaacaactacaccgaggtcaaggatgtgtggatcagcctgagctga

SEQ ID NO: 615 - protein, 490 aa, Geobacillus stearothermophilus
IAAPKLKEKVEKFLSGKKKMYINGSFVESASGKTFDTPNPATGERLATVYEGDAEDIDRAVKAAREAFDRGPWSRMSAAERSRLMYKLADLMEENKEELAQLETLDNGKPIRETINADVPLAIEHMRYYAGWSTKIVGQTIPVNGPYFNYTRHEPVGVVGQIIPWNFPLLMAMWKLGAALATGCTVVLKPAEQTPLSALYLAELIEEAGFPAGVVNIVPGFGETAGDALVKHPQVDKIAFTGSTEVGKLIMANASKSLKRVTLELGGKSPNIILPDADFSKAIPGALNGVMFNQGQVCCAGSRVFIQKKQYDNVVADMVSHAKSIKQGFGLKADTEMGPLVSSEQQNRVLGYIEKGLEEGAELLTGGQKPSEQGYFVEPTIFANVEDSMTISKEEIFGPVIAALPYEDIDELIERANDTNYGLAAGVWTRDVTKAHYIANKLRAGTVWVNCYNVFDAASPFGGYKESGIGREMGSYALDNYTEVKSVWIA

SEQ ID NO: 616 - protein, 481 aa, Bacillus coagulans 36D1
VQHFLQGKKKMFINGQFVESASGKTFDTPNPATGETLATIYEGDKQDIDRAVQAARKAFDEGPWPRMNPADRSRLMYKLADLMEEHREALAQLETLDNGKPIRETANADIPLAIEHMRYYAGWTTKITGQTIPVNGPYFNYTRHEPVGVVGQIIPWNFPLLMAMWKMGAALATGCTIILKPAEQTPLSALYLAQLVSEAGFPDGVVNIVPGFGETAGAALVDHPLVDKIAFTGSTEVGKLIMANASKTLKRVTLELGGKSPNIILPDADLSKAIPGALNGVMFNQGQVCCAGSRVFIQKKHFDNVIADMASHAQSIKQGFGLNKDTEMGPLVSDEQQARVLNYIEKGLDEGAEIVTGGKKPREEGFFVEPTIFADVRDEMTIAKEEIFGPVIAAMPYESLDEVISRANCSEYGLAAGVWTENVANAHYIANRLRAGTVWVNCYNVFDAASPFGGYKQSGIGREMGSYALQNYTEVKSVWIA

SEQ ID NO: 617 - protein, 487 aa, Bacillus cereus subsp. cytotoxis NVH 391-98
LHEKVEQFLQGTKKLYVNGTFVESVSGKTFKTPNPATGETLAIVSEAGREDIHKAVMAARQAFDEGPWSCMSGAERSRLMYKLADLMEEHKNELAQLETLDNGKPIRETLAADIPLAIEHMRYYAGWATKIVGQTIPVSGEYFNYTRHEAVGVVGQIIPWNFPLLMAMWKMGAALATGCTIVLKPAEQTPLSALYLAELFEEAGFPKGVVNIVPGFGEIAGQALVNHPFVDKIAFTGSTPVGKQIMRQASETLKRVTLELGGKSPNIILPDADLSRAIPAALSGVMFNQGQVCCAGSRLFIPKKMYDNVMADLVLYSKNLTQGAGLDPKTTIGPLVSEEQQQRVMGYIEKGIEEGAEVLCGGNKPFDKGYFVAPTVFADVNDEMTIAKEEIFGPVISALPFNDIDEVIERANKSSFGLAAGVWTENIKNAHYIASKVRAGTVWVNCYNVFDAASPFGGYKQSGLGREMGSYALDNYTEVKSVWVNLN

SEQ ID NO: 618 - protein, 487 aa, Bacillus cereus ATCC 14579
LHEKVEKFLQGTKKLYVNGSFIESASGKTFKTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGVGLNPETTIGPLVSEEQQKRVMGYIEKGIEEGAEVLCGGSNPFDQGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 619 - protein, 487 aa, Bacillus cereus ATCC 10987
LHEKVEKFLQGTKKLYVNGSFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGAGLSPETTIGPLVSEEQQKRVMGYIEKGIEEGAEVLCGGSNPFDRGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 620 - protein, 497 aa, Artificial
  Substituion in SEQ ID NO 613
MAVQEVNASALHPDVVEFLKGPKGLFIDGEFVPSISGKTFKSINPATEEVLVEVAEAEAPDIDRAVKAARRAFESGPWSRMSAAERSRLLYRLADLMEEHKLQLAQLETLDNGKPIRESLNADLPLAIEHIRYYAGWPTKVVGQTIPVAGKYFNYTRHEPVGVVGQIIPWNFPLLMACWKIGAALAMGCTVVLKPAEQTPLSALYLAKLIQEAGFPPGVVNVVPGFGETAGQALVEHPDVNKIAFTGSTEVGKLIMRNAAATLKRVTLELGGKSPNIILPDADMSRAIPGAFMGIMFNQGQVCCAGSRLFVQKKAYDNVVADLVSLAKKIRQGPGLDQGTEMGPLVSDEQEKRVLGYIEKGVEEGAEVLVGGGKATDRGYFVQPTIFANVRDDMTIAREEIFGPVVAAMPFEDLDEVIARANDTEYGLAAGVWTENIRNAHYIASKLKAGTVWVNCYNVFDAAAPFGGYKQSGIGREMGSYALNNYTEVKDVWISLS

SEQ ID NO: 621 - protein, 497 aa, Artificial
  Substituion in SEQ ID NO 613
MAVQEVNASALHPEVVEFLKGPKGLFIDGEFVPSLSGKTFKSINPATEEVLVEVAEAEAPDIDRAVKAARRAFESGPWSRMSAAERSRLLYRLADLMEEHKLQLAQLETLDNGKPIRESLNADLPLAIEHIRYYAGWPTKVVGQTIPVAGKYFNYTRHEPVGVVGQIIPWNFPLLMACWKIGAALAMGCTVVLKPAEQTPLSALYLAKLIQEAGFPPGVVNVVPGFGETAGQALVEHPDVNKIAFTGSTEVGKLIMRNAAATLKRVTLELGGKSPNIILPDADMSRAIPGAFMGIMFNQGQVCCAGSRLFVQKKAYDNVVADLVSLAKKIRQGPGLDQGTEMGPLVSDEQEKRVLGYIEKGVEEGAEVLVGGGKATDRGYFVQPTIFANVRDDMTIAREEIFGPVVAAMPFEDLDEVIARANDTEYGLAAGVWTENIRNAHYIASKLKAGTVWVNCYNVFDAAAPFGGYKQSGIGREMGSYALNNYTEVKDVWISLS

SEQ ID NO: 622 - protein, 497 aa, Artificial
  Substituion in SEQ ID NO 613
MAVQEVNASALHPDVVEFLKGPKGLFIDGEFVPSLSGKTFKSINPATEEVLVEVAEAEAPDIDRAVKAARRAFESGPWSRMSAAERSRLLYRLADLMEEHKLQLAQLETLDNGKPIRESLNADLPLAIEHIRYYAGWPTKVVGQTIPVAGKYFNYTRHEPVGVVGQIIPWNFPLLMACWKIGAALAMGCTVVLKPAEQTPLSALYLAKLIQEAGFPPGVVNVVPGFGETAGQALVEHPDVNKIAFTGSTEVGKLIMRNAAATLKRVTLELGGKSPNIILPDADMSRAIPGAFMGIMFNQGQVCCAGSRLFVQKKAYDNVVADLVSLAKKIRQGPGLDQGTEMGPLVSDEQEKRVLGYIEKGVEEGAEVLVGGGKATDRGYFVQPTIFANVRDDMTIAREEIFGPVVAAMPFEDLDEVIARANETEYGLAAGVWTENIRNAHYIASKLKAGTVWVNCYNVFDAAAPFGGYKQSGIGREMGSYALNNYTEVKDVWISLS

SEQ ID NO: 623 - protein, 497 aa, Artificial
  Substituion in SEQ ID NO 613
MAVQEVNASALHPDVVEFLKGPKGLFIDGEFVPSLSGKTFKSINPATEEVLVEVAEAEAPDIDRAVKAARRAFESGPWSRMSAAERSRLLYRLADLMEEHKLQLAQLETLDNGKPIRESLNADLPLAIEHIRYYAGWPTKVVGQTIPVAGKYFNYTRHEPVGVVGQIIPWNFPLLMACWKIGAALAMGCTVVLKPAEQTPLSALYLAKLIQEAGFPPGVVNVVPGFGETAGQALVEHPDVNKIAFTGSTEVGKLIMRNAAATLKRVTLELGGKSPNIILPDADMSRAIPGAFMGIMFNQGQVCCAGSRLFVQKKAYDNVVADLVSLAKKIRQGPGLDQGTEMGPLVSDEQEKRVLGYIEKGVEEGAEVLVGGGKATDRGYFVNPTIFANVRDDMTIAREEIFGPVVAAMPFEDLDEVIARANDTEYGLAAGVWTENIRNAHYIASKLKAGTVWVNCYNVFDAAAPFGGYKQSGIGREMGSYALNNYTEVKDVWISLS

SEQ ID NO: 624 - protein, 497 aa, Artificial
  Substituion in SEQ ID NO 613
MAVQEVNASALHPDVVEFLKGPKGLFIDGEFVPSLSGKTFKSINPATEEVLVEVAEAEAPDIDRAVKAARRAFESGPWSRMSAAERSRLLYRLADLMEEHKLQLAQLETLDNGKPIRESINADLPLAIEHIRYYAGWPTKVVGQTIPVAGKYFNYTRHEPVGVVGQIIPWNFPLLMACWKIGAALAMGCTVVLKPAEQTPLSALYLAKLIQEAGFPPGVVNVVPGFGETAGQALVEHPDVNKIAFTGSTEVGKLIMRNAAATLKRVTLELGGKSPNIILPDADMSRAIPGAFMGIMFNQGQVCCAGSRLFVQKKAYDNVVADLVSLAKKIRQGPGLDQGTEMGPLVSDEQEKRVLGYIEKGVEEGAEVLVGGGKATDRGYFVQPTIFANVRDDMTIAREEIFGPVVAAMPFEDLDEVIARANDTEYGLAAGVWTENIRNAHYIASKLKAGTVWVNCYNVFDAAAPFGGYKQSGIGREMGSYALNNYTEVKDVWISLS

SEQ ID NO: 625 - DNA, 1494 bp, Artificial
  Substituion in SEQ ID NO 614
gtggcagttcaagaagtgaatgcgagcgctctgcatccggatgtcgtcgagtttctcaagggtcccaagggcctgttcattgacggcgaattcgttccctcaatttccggcaaaacgttcaagtctatcaaccctgcgacagaagaagtcctggtggaagtcgcggaggcggaagctcccgacattgaccgcgcggtcaaagccgctcgccgcgcctttgagtccggcccgtggtcgcgcatgagcgccgcggagcggtcccggcttctctataggctggcggatctcatggaagaacataagctgcagctcgctcagctcgaaaccctcgacaacggcaaacccattcgcgaatccctgaacgcagacctgccgcttgccatcgaacacattcgctactacgccggctggcccaccaaggtcgtggggcaaaccattccggtagcgggaaaatacttcaactacacgcgacacgagcccgtcggcgtcgtgggccagatcatcccgtggaacttcccgctcctcatggcgtgctggaagattggcgccgcgctggccatgggctgcacggtggtgctcaagccggcggagcagacgccgctctccgcgctctacctggccaaactgatccaagaggctggcttcccgccgggcgtcgtcaatgtcgtgccgggcttcggcgagaccgccggacaggcactggtggagcacccggacgtcaacaagattgcgttcaccggatcgacggaggtcggcaagctcatcatgcgcaacgccgcggcgaccttgaagcgcgtcacgctcgagctcggcggcaagtccccgaacatcattctccccgatgccgacatgagccgagccatccccggcgcgttcatgggcatcatgttcaaccagggccaggtgtgctgcgccggatcgcgcctgttcgtgcagaagaaagcgtacgacaacgtggtggccgatctcgtctccctcgcgaagaagatccgccaaggcccgggcttggatcaaggcacggagatggggccgctcgtgtccgatgaacaggagaagcgcgtgctgggctacatcgagaagggcgtggaagagggcgccgaggtcctcgtcggcggcggcaaggccacggatcgcggatacttcgtgcagccgaccatcttcgccaatgtccgggacgacatgaccatcgcgcgcgaggagatcttcggaccggtggtcgcggcgatgccgtttgaagatttggacgaagtcattgcgcgcgcgaacgacacggagtacggcctggcggccggtgtgtggacggagaacatccggaatgcccactatatcgccagcaagctgaaggccggcactgtttgggtcaactgctacaacgtgtttgacgcggcggctcccttcggtggatacaagcagtccggtatcgggcgcgaaatgggctcgtacgcgttgaacaactacaccgaggtcaaggatgtgtggatcagcctgagctga

SEQ ID NO: 626 - DNA, 1494 bp, Artificial
  Substituion in SEQ ID NO 614
gtggcagttcaagaagtgaatgcgagcgctctgcatccggaagtcgtcgagtttctcaagggtcccaagggcctgttcattgacggcgaattcgttccctcactctccggcaaaacgttcaagtctatcaaccctgcgacagaagaagtcctggtggaagtcgcggaggcggaagctcccgacattgaccgcgcggtcaaagccgctcgccgcgcctttgagtccggcccgtggtcgcgcatgagcgccgcggagcggtcccggcttctctataggctggcggatctcatggaagaacataagctgcagctcgctcagctcgaaaccctcgacaacggcaaacccattcgcgaatccctgaacgcagacctgccgcttgccatcgaacacattcgctactacgccggctggcccaccaaggtcgtggggcaaaccattccggtagcgggaaaatacttcaactacacgcgacacgagcccgtcggcgtcgtgggccagatcatcccgtggaacttcccgctcctcatggcgtgctggaagattggcgccgcgctggccatgggctgcacggtggtgctcaagccggcggagcagacgccgctctccgcgctctacctggccaaactgatccaagaggctggcttcccgccgggcgtcgtcaatgtcgtgccgggcttcggcgagaccgccggacaggcactggtggagcacccggacgtcaacaagattgcgttcaccggatcgacggaggtcggcaagctcatcatgcgcaacgccgcggcgaccttgaagcgcgtcacgctcgagctcggcggcaagtccccgaacatcattctccccgatgccgacatgagccgagccatccccggcgcgttcatgggcatcatgttcaaccagggccaggtgtgctgcgccggatcgcgcctgttcgtgcagaagaaagcgtacgacaacgtggtggccgatctcgtctccctcgcgaagaagatccgccaaggcccgggcttggatcaaggcacggagatggggccgctcgtgtccgatgaacaggagaagcgcgtgctgggctacatcgagaagggcgtggaagagggcgccgaggtcctcgtcggcggcggcaaggccacggatcgcggatacttcgtgcagccgaccatcttcgccaatgtccgggacgacatgaccatcgcgcgcgaggagatcttcggaccggtggtcgcggcgatgccgtttgaagatttggacgaagtcattgcgcgcgcgaacgacacggagtacggcctggcggccggtgtgtggacggagaacatccggaatgcccactatatcgccagcaagctgaaggccggcactgtttgggtcaactgctacaacgtgtttgacgcggcggctcccttcggtggatacaagcagtccggtatcgggcgcgaaatgggctcgtacgcgttgaacaactacaccgaggtcaaggatgtgtggatcagcctgagctga

SEQ ID NO: 627 - DNA, 1494 bp, Artificial
  Substituion in SEQ ID NO 614
gtggcagttcaagaagtgaatgcgagcgctctgcatccggatgtcgtcgagtttctcaagggtcccaagggcctgttcattgacggcgaattcgttccctcactctccggcaaaacgttcaagtctatcaaccctgcgacagaagaagtcctggtggaagtcgcggaggcggaagctcccgacattgaccgcgcggtcaaagccgctcgccgcgcctttgagtccggcccgtggtcgcgcatgagcgccgcggagcggtcccggcttctctataggctggcggatctcatggaagaacataagctgcagctcgctcagctcgaaaccctcgacaacggcaaacccattcgcgaatccctgaacgcagacctgccgcttgccatcgaacacattcgctactacgccggctggcccaccaaggtcgtggggcaaaccattccggtagcgggaaaatacttcaactacacgcgacacgagcccgtcggcgtcgtgggccagatcatcccgtggaacttcccgctcctcatggcgtgctggaagattggcgccgcgctggccatgggctgcacggtggtgctcaagccggcggagcagacgccgctctccgcgctctacctggccaaactgatccaagaggctggcttcccgccgggcgtcgtcaatgtcgtgccgggcttcggcgagaccgccggacaggcactggtggagcacccggacgtcaacaagattgcgttcaccggatcgacggaggtcggcaagctcatcatgcgcaacgccgcggcgaccttgaagcgcgtcacgctcgagctcggcggcaagtccccgaacatcattctccccgatgccgacatgagccgagccatccccggcgcgttcatgggcatcatgttcaaccagggccaggtgtgctgcgccggatcgcgcctgttcgtgcagaagaaagcgtacgacaacgtggtggccgatctcgtctccctcgcgaagaagatccgccaaggcccgggcttggatcaaggcacggagatggggccgctcgtgtccgatgaacaggagaagcgcgtgctgggctacatcgagaagggcgtggaagagggcgccgaggtcctcgtcggcggcggcaaggccacggatcgcggatacttcgtgcagccgaccatcttcgccaatgtccgggacgacatgaccatcgcgcgcgaggagatcttcggaccggtggtcgcggcgatgccgtttgaagatttggacgaagtcattgcgcgcgcgaacgaaacggagtacggcctggcggccggtgtgtggacggagaacatccggaatgcccactatatcgccagcaagctgaaggccggcactgtttgggtcaactgctacaacgtgtttgacgcggcggctcccttcggtggatacaagcagtccggtatcgggcgcgaaatgggctcgtacgcgttgaacaactacaccgaggtcaaggatgtgtggatcagcctgagctga

SEQ ID NO: 628 - DNA, 1494 bp, Artificial
  Substituion in SEQ ID NO 614
gtggcagttcaagaagtgaatgcgagcgctctgcatccggatgtcgtcgagtttctcaagggtcccaagggcctgttcattgacggcgaattcgttccctcactctccggcaaaacgttcaagtctatcaaccctgcgacagaagaagtcctggtggaagtcgcggaggcggaagctcccgacattgaccgcgcggtcaaagccgctcgccgcgcctttgagtccggcccgtggtcgcgcatgagcgccgcggagcggtcccggcttctctataggctggcggatctcatggaagaacataagctgcagctcgctcagctcgaaaccctcgacaacggcaaacccattcgcgaatccctgaacgcagacctgccgcttgccatcgaacacattcgctactacgccggctggcccaccaaggtcgtggggcaaaccattccggtagcgggaaaatacttcaactacacgcgacacgagcccgtcggcgtcgtgggccagatcatcccgtggaacttcccgctcctcatggcgtgctggaagattggcgccgcgctggccatgggctgcacggtggtgctcaagccggcggagcagacgccgctctccgcgctctacctggccaaactgatccaagaggctggcttcccgccgggcgtcgtcaatgtcgtgccgggcttcggcgagaccgccggacaggcactggtggagcacccggacgtcaacaagattgcgttcaccggatcgacggaggtcggcaagctcatcatgcgcaacgccgcggcgaccttgaagcgcgtcacgctcgagctcggcggcaagtccccgaacatcattctccccgatgccgacatgagccgagccatccccggcgcgttcatgggcatcatgttcaaccagggccaggtgtgctgcgccggatcgcgcctgttcgtgcagaagaaagcgtacgacaacgtggtggccgatctcgtctccctcgcgaagaagatccgccaaggcccgggcttggatcaaggcacggagatggggccgctcgtgtccgatgaacaggagaagcgcgtgctgggctacatcgagaagggcgtggaagagggcgccgaggtcctcgtcggcggcggcaaggccacggatcgcggatacttcgtgaatccgaccatcttcgccaatgtccgggacgacatgaccatcgcgcgcgaggagatcttcggaccggtggtcgcggcgatgccgtttgaagatttggacgaagtcattgcgcgcgcgaacgacacggagtacggcctggcggccggtgtgtggacggagaacatccggaatgcccactatatcgccagcaagctgaaggccggcactgtttgggtcaactgctacaacgtgtttgacgcggcggctcccttcggtggatacaagcagtccggtatcgggcgcgaaatgggctcgtacgcgttgaacaactacaccgaggtcaaggatgtgtggatcagcctgagctga

SEQ ID NO: 629 - DNA, 1494 bp, Artificial
  Substituion in SEQ ID NO 614
gtggcagttcaagaagtgaatgcgagcgctctgcatccggatgtcgtcgagtttctcaagggtcccaagggcctgttcattgacggcgaattcgttccctcactctccggcaaaacgttcaagtctatcaaccctgcgacagaagaagtcctggtggaagtcgcggaggcggaagctcccgacattgaccgcgcggtcaaagccgctcgccgcgcctttgagtccggcccgtggtcgcgcatgagcgccgcggagcggtcccggcttctctataggctggcggatctcatggaagaacataagctgcagctcgctcagctcgaaaccctcgacaacggcaaacccattcgcgaatccattaacgcagacctgccgcttgccatcgaacacattcgctactacgccggctggcccaccaaggtcgtggggcaaaccattccggtagcgggaaaatacttcaactacacgcgacacgagcccgtcggcgtcgtgggccagatcatcccgtggaacttcccgctcctcatggcgtgctggaagattggcgccgcgctggccatgggctgcacggtggtgctcaagccggcggagcagacgccgctctccgcgctctacctggccaaactgatccaagaggctggcttcccgccgggcgtcgtcaatgtcgtgccgggcttcggcgagaccgccggacaggcactggtggagcacccggacgtcaacaagattgcgttcaccggatcgacggaggtcggcaagctcatcatgcgcaacgccgcggcgaccttgaagcgcgtcacgctcgagctcggcggcaagtccccgaacatcattctccccgatgccgacatgagccgagccatccccggcgcgttcatgggcatcatgttcaaccagggccaggtgtgctgcgccggatcgcgcctgttcgtgcagaagaaagcgtacgacaacgtggtggccgatctcgtctccctcgcgaagaagatccgccaaggcccgggcttggatcaaggcacggagatggggccgctcgtgtccgatgaacaggagaagcgcgtgctgggctacatcgagaagggcgtggaagagggcgccgaggtcctcgtcggcggcggcaaggccacggatcgcggatacttcgtgcagccgaccatcttcgccaatgtccgggacgacatgaccatcgcgcgcgaggagatcttcggaccggtggtcgcggcgatgccgtttgaagatttggacgaagtcattgcgcgcgcgaacgacacggagtacggcctggcggccggtgtgtggacggagaacatccggaatgcccactatatcgccagcaagctgaaggccggcactgtttgggtcaactgctacaacgtgtttgacgcggcggctcccttcggtggatacaagcagtccggtatcgggcgcgaaatgggctcgtacgcgttgaacaactacaccgaggtcaaggatgtgtggatcagcctgagctga

SEQ ID NO: 630 - protein, 442 aa, Alicyclobacillus acidocaldarius
MVNEPTAVAAKGSDFRFPDAPEEEKYSVCVHCGFCLEVCPTYQAWGDENHSPRGRVYLIKACAEGELPLDESVIDPVFTCLDCRACETVCPSGVQVGALVEEARGQVFYARDAEGKRDPVMRFFLRGVFPRPARLRIIRRLMRFYQKSGLQKLARSTGVLRVLPPQVREMEDVIPEIGRGPAIDVLPETIAPQGERKATAALFTGCVMDVFFSDVNEATARVLVRNGVEVRVPKDQICCGALQVHAGDRDMAREMAKRNIEVFERAGADYVAINAAGCGAALKEYPELFRDDPAWRDRAVQFSSRVRDISQLLVEVGFDPPKAELPMAVTYHDACHLFHAQKIRYEPRSLLKSVPGLTLCEMPDSDRCCGSAGIYNLTHPAMANELLERKMDDVPEGVDAIVMGNPGCMMQIRLGVKRRNQPLRVMHTVEVLDLAYRREGSR

SEQ ID NO: 631 - DNA, 1329 bp, Alicyclobacillus acidocaldarius
atggtgaacgagcccacggccgtcgctgcgaaagggtccgattttcgctttccggacgcgcccgaggaagagaagtactcggtctgcgtgcattgcggcttctgcctggaggtgtgtccgacgtatcaggcgtggggcgacgagaatcattcgccccgcgggcgcgtgtacctgatcaaagcgtgcgcagaaggcgagcttccgctcgacgagagcgtgatcgatcccgtcttcacctgcctcgactgccgggcctgcgagaccgtgtgcccgtctggcgtgcaggtgggggcgctcgtcgaggaggcgcgcggccaggtgttttacgcgcgcgacgcggaagggaagcgggaccccgtcatgcgcttcttcctgcgcggcgtgtttccgcgcccggcgcgccttcggatcatccgacgtctcatgcggttctatcagaagtcggggctccagaaactggcgcgatcgaccggcgtcctgcgcgtgctgccgccgcaggtgcgcgagatggaggacgtcatcccggaaatcggacgggggcccgccatcgacgtcctgccggaaacgatagccccgcaaggggagcgcaaggccacggcggcgcttttcacgggctgcgtgatggacgtgttcttctccgacgtgaacgaggccaccgcgcgcgtcctcgtgcgaaacggcgtcgaggtgcgcgtgcccaaggatcagatctgctgcggcgcgctccaggtgcacgcgggcgatcgcgacatggcccgcgagatggcgaagcgaaacatcgaggtgtttgagcgcgcgggcgccgattacgtcgccatcaacgcggccggctgcggcgccgcgctgaaggaatacccggagctcttccgcgacgacccggcctggcgggatcgcgccgtgcagttctcgtcccgcgtgcgcgacatctctcagctcctcgtcgaggtcggcttcgatccgccgaaggccgagctgcccatggccgtcacgtaccacgacgcgtgccacctgttccacgcgcagaagatccggtacgagccgcgatcgctgctcaagtcggtgccgggcctgacgctttgcgagatgccggattccgaccgatgctgtggcagcgcgggcatctacaacctcacgcacccggcgatggctaacgagcttctcgagcgcaagatggacgacgtgcccgagggcgtggacgccatcgtcatggggaaccccggttgcatgatgcagatccggctcggcgtcaagcgcaggaaccagccattgcgcgtcatgcacacggtcgaagtgctcgatctcgcctaccggagggagggatcgcgatga

SEQ ID NO: 632 - protein, 434 aa, Geobacillus thermodenitrificans NG80-2
PACATASLGNYRFADLPDPSKWADCVHCGMCLESCPTYEQTGEEQHSPRGRVHLMKSVGEGKLDLTPDLLDPIFTCLDCRACTTACPADVDVGGLIEQVRGQLRQAVPLTGWKALVNDFFLKGIFPHPSRLDWLGRLLKLYQQSGLQTVARKTGMLRVMPDHLAEMEAILPKVGTPVRKKYRNEPLIKAKGETKRTVAILTGCIMDVMFSDINEATIRVLTRNGNDVVIVSDQTCCGALHVHAGDRETGRKLAKQNIEAFQGVDHVIVNAAGCGAMLKEYPELFRHDPEWHEKAEQFAAKVEDVSKFLYDTGFKAPKAELNVRLTYHDACHLAHGQGIRKEPRAVIESIPGVEMVAMPNADRCCGSAGIYNLTHPDMAQAVLESKMQNVPQDVELISMGNPGCMLQMALGVMKHGRNQKIVHTVQLLDWAYQKE

SEQ ID NO: 633 - protein, 435 aa, Bacillus clausii KSM-K16
DPPCSPTSKSNYLWNDAPDENKWADCVHCGMCLESCPTYEITGQEQHSPRGRVHLIKSVAEGKLEVNEPFIDPVYQCLDCRACTTACPADVDVGGLIEEARGQIRQAMPLTGIKGLVSKFFLEGLFPHPKRMQSLGGLLKIYQKSGVQKLVRTTRLIRIMPKHLVELEAIMPGMGVPVRKKYKNENIILAKGEETHTVAFLTGCIMDVMFSDINESTIQVLTRNGNNVTIPKQQTCCGALHVHAGDRETGRRLAKQNIEAFENAQTVIVNAAGCGCMLKDYPELFRDDPKWHEKAKAFSAKVQDITKYLYDTGYEKPKSEMKIRLTYHDACHLAHGQGIRQEPRELLHAIPGVEIVHMPNADRCCGSAGIYNITNPEMAGAVLESKMENVPEDVEMISMGNPGCMLQMAVGVQKYGRRQKIVHTVQLLNWAYKRD

SEQ ID NO: 634 - protein, 427 aa, Bacillus halodurans C-125
TNYHWSDHPDPNKWADCVHCGMCLEACPTYELTGHEQQSPRGRVHLIKSVAEGKLEVNEAFADPVFTCLDCRACETACPADVEVGGLIEEARGQIRQALPLSGWKKVVSHLFLRGLFPYPHRLHALGSLVKVYQKVGIRKAVRKTGLLHLFPEHFADMEAVIPEVSTPVQKRYRKKSFIKAKGKSKQRVTLLAGCVMDVMFSEVNEATIRVLTRNGNDVSLPKDQTCCGALHVHAGDREMGRRLAKQNMKAFENEETIIVNAAGCGSMLQEYPELFREVEREWYERAEAFAEKVKDVSKHLYDTGYEKPKGEVRAKVAYHDACHLAHGQNVRQEPRDLLLKISGVELIPMENADRCCGSAGIYNLTHPKMASRVLEKKMECVPSDVEMVSMGNPGCMLQMAMGVKKYGGNQRIIHTVQLLDLAYQQE

SEQ ID NO: 635 - protein, 366 aa, Geobacillus kaustophilus HTA426
LLDPIFTCLDCRACTTACPADVDVGGLIEQVRGQLRQAVPLTGWKALVSDVFLKGIFPHPSRLDWLGRLLKWYQKSGLQTVARKTGLLRVMPDHLAEMEAILPAVGTPVRRKYKHQPLIKAKGETKRTVAILTGCVMDVMFSDINEATIRVLTHNGNDVVIVPNQTCCGALHVHAGDRETGRKLAKQNIEAFQHVDHVIVNAAGCGCMLKEYPELFRHDPEWHEKAEQFAAKVEDVSKFLHDTGFKPPKAELNVRLTYHDACHLAHGQGIRQEPRALIESIPGVEMVAMPNADRCCGSAGIYNLTHPEMAQAVLESKMQHVPQEVELISMGNPGCMLQMALGVMKHGRNQKIVHTVQLLDWAYQKE

SEQ ID NO: 636 - protein, 417 aa, Saccharopolyspora erythraea NRRL 2338
PQRELIDDCVHCGFCLPSCPTYELWGEEMDSPRGRIYLMKEGLEGEPMTGSMVGHFDACLGCMACVTACPSGVQYGTLITETRAQVERRHERGRWEKLLRAGIFALFPYPRRLRAMRGPLALYQKTGLSKLVKRSGLLRKMPASLRVMESLAPPISRAPKLGNRVPARGTRRATVGMITGCVQSAFFPDVNAATARVLSAEGCDVVIPRAQGCCGALSEHTGREEEAVRFARNLLDTFEDAGVEYVVINSAGCGSTLKEYPRLLRDDPEYAEKAERFSARVRDIAELLVELGPVAERHPLPVRAAYHDACHLAHGQGIRSQPRELLRGIPGMEVREINRGELCCGSAGVYNILQPEAAMDLGDRKAENVLDTGAELLISANPGCAMQIRTSLERRGSELAMAHTVEVLDASIRGLGA

SEQ ID NO: 637 - protein, 442 aa, Artificial
  Substituion in SEQ ID NO 630
MVNEPTAVAAKGSDFRFPDAPEEEKYSVCVHCGFCLEVCPTYQAWGDENHSPRGRVYLIKACAEGELPLDESVIDPVFTCLDCRACETVCPSGVQVGALVEEARGQVFYARDAEGKRDPVMRFFLRGVFPRPARLRIIRRLMRFYQKSGLQKLARSTGVLRVLPPQVREMEDVIPEIGRGPAIDVLPETIAPQGERRATAALFTGCVMDVFFSDVNEATARVLVRNGVEVRVPKDQICCGALQVHAGDRDMAREMAKRNIEVFERAGADYVAINAAGCGAALKEYPELFRDDPAWRDRAVQFSSRVRDISQLLVEVGFDPPKAELPMAVTYHDACHLFHAQKIRYEPRSLLKSVPGLTLCEMPDSDRCCGSAGIYNLTHPAMANELLERKMDDVPEGVDAIVMGNPGCMMQIRLGVKRRNQPLRVMHTVEVLDLAYRREGSR

SEQ ID NO: 638 - protein, 442 aa, Artificial
  Substituion in SEQ ID NO 630
MVNEPTAVAAKGSDFRFPDAPEEEKYSVCVHCGFCLEVCPTYQAWGDENHSPRGRVYLIKACAEGELPLDESVIDPVFTCLDCRACETVCPSGVQVGALVEEARGQVFYARDAEGKRDPVMRFFLRGVFPRPARLRIIRRLMRFYQKSGLQKIARSTGVLRVLPPQVREMEDVIPEIGRGPAIDVLPETIAPQGERKATAALFTGCVMDVFFSDVNEATARVLVRNGVEVRVPKDQICCGALQVHAGDRDMAREMAKRNIEVFERAGADYVAINAAGCGAALKEYPELFRDDPAWRDRAVQFSSRVRDISQLLVEVGFDPPKAELPMAVTYHDACHLFHAQKIRYEPRSLLKSVPGLTLCEMPDSDRCCGSAGIYNLTHPAMANELLERKMDDVPEGVDAIVMGNPGCMMQIRLGVKRRNQPLRVMHTVEVLDLAYRREGSR

SEQ ID NO: 639 - protein, 442 aa, Artificial
  Substituion in SEQ ID NO 630
MVNEPTAVAAKGSDFRFPDAPEEEKYSVCVHCGFCLEVCPTYQAWGDENHSPRGRVYLIKACAEGELPLDESVIDPVFTCLDCRACETVCPSGVQVGALVEEARGQVFYARDAEGKRDPVMRFFLRGVFPRPARLRIIRRLMRFYQKSGLQKLARSTGVLRVLPPQVREMEDVIPEIGRGPAIDVLPETIAPQGERKATAALFTGCVMDVFFSDVNEATARVLVRNGVEVRVPKDQICCGALQVHAGDRDMAREMAKRNIEVFERAGADYVAINAAGCGAALKEYPELFRDDPAWRDRAVQFSSRVRDISQLLVEVGFDPPKAELPMAVTYHDACHLFHAQKIRYEPRSLLKSVPGLTLCEMPDSDRCCGSAGIYNLTHPAMANELLERKMDDVPEGVDAIVMGNPGCMMQIRLGVKRRNQPLRVMHTVEVLDLAYRREGSK

SEQ ID NO: 640 - protein, 442 aa, Artificial
  Substituion in SEQ ID NO 630
MVNEPTAVAAKGSDFRFPDAPEEEKYSVCVHCGFCLEVCPTYQAWGDENHSPRGRVYLIKACAEGELPLDESVIDPVFTCLDCRACETVCPSGVQVGALVEEARGQVFYARDAEGKRDPVMRFFLRGVFPRPARLRIIRRLMRFYQKSGLQKLARSTGVLRVLPPQVREMEDVIPEIGRGPAIDVLPETIAPQGERKATAALFTGCVMDVFFSDVNEATARVLVRNGVEVRVPKDQICCGALQVHAGDRDMAREMAKRNIEVFERAGADYVAINAAGCGAALKEYPELFRDDPAWRDRAVQFSSRVRDISQLLVEVGFDPPKAELPMAVTYHDACHLFHAQKIRYEPRSLLKSVPGLTLCEMPDSDRCCGSAGIYNLTHPAMANELLERKMDDVPEGVDAIVMGNPGCMMQIRIGVKRRNQPLRVMHTVEVLDLAYRREGSR

SEQ ID NO: 641 - protein, 442 aa, Artificial
  Substituion in SEQ ID NO 630
MVNEPTAVAAKGSDFRFPDAPEEEKYSVCVHCGFCLEVCPTYQAWGDENHSPRGRVYLIKACAEGELPLDESVIDPVFTCLDCRACETVCPSGVQVGALVEEARGQVFYARDAEGKRDPVMRFFLRGVFPRPARLRIIRRLMRFYQKSGLQKLARSTGVLRVLPPQVREMEDVIPEIGRGPAIDVLPETIAPQGERKATAALFTGCVMDVFFSDVNEATARVLVRNGVEVKVPKDQICCGALQVHAGDRDMAREMAKRNIEVFERAGADYVAINAAGCGAALKEYPELFRDDPAWRDRAVQFSSRVRDISQLLVEVGFDPPKAELPMAVTYHDACHLFHAQKIRYEPRSLLKSVPGLTLCEMPDSDRCCGSAGIYNLTHPAMANELLERKMDDVPEGVDAIVMGNPGCMMQIRLGVKRRNQPLRVMHTVEVLDLAYRREGSR

SEQ ID NO: 642 - DNA, 1329 bp, Artificial
  Substituion in SEQ ID NO 631
atggtgaacgagcccacggccgtcgctgcgaaagggtccgattttcgctttccggacgcgcccgaggaagagaagtactcggtctgcgtgcattgcggcttctgcctggaggtgtgtccgacgtatcaggcgtggggcgacgagaatcattcgccccgcgggcgcgtgtacctgatcaaagcgtgcgcagaaggcgagcttccgctcgacgagagcgtgatcgatcccgtcttcacctgcctcgactgccgggcctgcgagaccgtgtgcccgtctggcgtgcaggtgggggcgctcgtcgaggaggcgcgcggccaggtgttttacgcgcgcgacgcggaagggaagcgggaccccgtcatgcgcttcttcctgcgcggcgtgtttccgcgcccggcgcgccttcggatcatccgacgtctcatgcggttctatcagaagtcggggctccagaaactggcgcgatcgaccggcgtcctgcgcgtgctgccgccgcaggtgcgcgagatggaggacgtcatcccggaaatcggacgggggcccgccatcgacgtcctgccggaaacgatagccccgcaaggggagcgccgtgccacggcggcgcttttcacgggctgcgtgatggacgtgttcttctccgacgtgaacgaggccaccgcgcgcgtcctcgtgcgaaacggcgtcgaggtgcgcgtgcccaaggatcagatctgctgcggcgcgctccaggtgcacgcgggcgatcgcgacatggcccgcgagatggcgaagcgaaacatcgaggtgtttgagcgcgcgggcgccgattacgtcgccatcaacgcggccggctgcggcgccgcgctgaaggaatacccggagctcttccgcgacgacccggcctggcgggatcgcgccgtgcagttctcgtcccgcgtgcgcgacatctctcagctcctcgtcgaggtcggcttcgatccgccgaaggccgagctgcccatggccgtcacgtaccacgacgcgtgccacctgttccacgcgcagaagatccggtacgagccgcgatcgctgctcaagtcggtgccgggcctgacgctttgcgagatgccggattccgaccgatgctgtggcagcgcgggcatctacaacctcacgcacccggcgatggctaacgagcttctcgagcgcaagatggacgacgtgcccgagggcgtggacgccatcgtcatggggaaccccggttgcatgatgcagatccggctcggcgtcaagcgcaggaaccagccattgcgcgtcatgcacacggtcgaagtgctcgatctcgcctaccggagggagggatcgcgatga

SEQ ID NO: 643 - DNA, 1329 bp, Artificial
  Substituion in SEQ ID NO 631
atggtgaacgagcccacggccgtcgctgcgaaagggtccgattttcgctttccggacgcgcccgaggaagagaagtactcggtctgcgtgcattgcggcttctgcctggaggtgtgtccgacgtatcaggcgtggggcgacgagaatcattcgccccgcgggcgcgtgtacctgatcaaagcgtgcgcagaaggcgagcttccgctcgacgagagcgtgatcgatcccgtcttcacctgcctcgactgccgggcctgcgagaccgtgtgcccgtctggcgtgcaggtgggggcgctcgtcgaggaggcgcgcggccaggtgttttacgcgcgcgacgcggaagggaagcgggaccccgtcatgcgcttcttcctgcgcggcgtgtttccgcgcccggcgcgccttcggatcatccgacgtctcatgcggttctatcagaagtcggggctccagaaaattgcgcgatcgaccggcgtcctgcgcgtgctgccgccgcaggtgcgcgagatggaggacgtcatcccggaaatcggacgggggcccgccatcgacgtcctgccggaaacgatagccccgcaaggggagcgcaaggccacggcggcgcttttcacgggctgcgtgatggacgtgttcttctccgacgtgaacgaggccaccgcgcgcgtcctcgtgcgaaacggcgtcgaggtgcgcgtgcccaaggatcagatctgctgcggcgcgctccaggtgcacgcgggcgatcgcgacatggcccgcgagatggcgaagcgaaacatcgaggtgtttgagcgcgcgggcgccgattacgtcgccatcaacgcggccggctgcggcgccgcgctgaaggaatacccggagctcttccgcgacgacccggcctggcgggatcgcgccgtgcagttctcgtcccgcgtgcgcgacatctctcagctcctcgtcgaggtcggcttcgatccgccgaaggccgagctgcccatggccgtcacgtaccacgacgcgtgccacctgttccacgcgcagaagatccggtacgagccgcgatcgctgctcaagtcggtgccgggcctgacgctttgcgagatgccggattccgaccgatgctgtggcagcgcgggcatctacaacctcacgcacccggcgatggctaacgagcttctcgagcgcaagatggacgacgtgcccgagggcgtggacgccatcgtcatggggaaccccggttgcatgatgcagatccggctcggcgtcaagcgcaggaaccagccattgcgcgtcatgcacacggtcgaagtgctcgatctcgcctaccggagggagggatcgcgatga

SEQ ID NO: 644 - DNA, 1329 bp, Artificial
  Substituion in SEQ ID NO 631
atggtgaacgagcccacggccgtcgctgcgaaagggtccgattttcgctttccggacgcgcccgaggaagagaagtactcggtctgcgtgcattgcggcttctgcctggaggtgtgtccgacgtatcaggcgtggggcgacgagaatcattcgccccgcgggcgcgtgtacctgatcaaagcgtgcgcagaaggcgagcttccgctcgacgagagcgtgatcgatcccgtcttcacctgcctcgactgccgggcctgcgagaccgtgtgcccgtctggcgtgcaggtgggggcgctcgtcgaggaggcgcgcggccaggtgttttacgcgcgcgacgcggaagggaagcgggaccccgtcatgcgcttcttcctgcgcggcgtgtttccgcgcccggcgcgccttcggatcatccgacgtctcatgcggttctatcagaagtcggggctccagaaactggcgcgatcgaccggcgtcctgcgcgtgctgccgccgcaggtgcgcgagatggaggacgtcatcccggaaatcggacgggggcccgccatcgacgtcctgccggaaacgatagccccgcaaggggagcgcaaggccacggcggcgcttttcacgggctgcgtgatggacgtgttcttctccgacgtgaacgaggccaccgcgcgcgtcctcgtgcgaaacggcgtcgaggtgcgcgtgcccaaggatcagatctgctgcggcgcgctccaggtgcacgcgggcgatcgcgacatggcccgcgagatggcgaagcgaaacatcgaggtgtttgagcgcgcgggcgccgattacgtcgccatcaacgcggccggctgcggcgccgcgctgaaggaatacccggagctcttccgcgacgacccggcctggcgggatcgcgccgtgcagttctcgtcccgcgtgcgcgacatctctcagctcctcgtcgaggtcggcttcgatccgccgaaggccgagctgcccatggccgtcacgtaccacgacgcgtgccacctgttccacgcgcagaagatccggtacgagccgcgatcgctgctcaagtcggtgccgggcctgacgctttgcgagatgccggattccgaccgatgctgtggcagcgcgggcatctacaacctcacgcacccggcgatggctaacgagcttctcgagcgcaagatggacgacgtgcccgagggcgtggacgccatcgtcatggggaaccccggttgcatgatgcagatccggctcggcgtcaagcgcaggaaccagccattgcgcgtcatgcacacggtcgaagtgctcgatctcgcctaccggagggagggatcgaaatga

SEQ ID NO: 645 - DNA, 1329 bp, Artificial
  Substituion in SEQ ID NO 631
atggtgaacgagcccacggccgtcgctgcgaaagggtccgattttcgctttccggacgcgcccgaggaagagaagtactcggtctgcgtgcattgcggcttctgcctggaggtgtgtccgacgtatcaggcgtggggcgacgagaatcattcgccccgcgggcgcgtgtacctgatcaaagcgtgcgcagaaggcgagcttccgctcgacgagagcgtgatcgatcccgtcttcacctgcctcgactgccgggcctgcgagaccgtgtgcccgtctggcgtgcaggtgggggcgctcgtcgaggaggcgcgcggccaggtgttttacgcgcgcgacgcggaagggaagcgggaccccgtcatgcgcttcttcctgcgcggcgtgtttccgcgcccggcgcgccttcggatcatccgacgtctcatgcggttctatcagaagtcggggctccagaaactggcgcgatcgaccggcgtcctgcgcgtgctgccgccgcaggtgcgcgagatggaggacgtcatcccggaaatcggacgggggcccgccatcgacgtcctgccggaaacgatagccccgcaaggggagcgcaaggccacggcggcgcttttcacgggctgcgtgatggacgtgttcttctccgacgtgaacgaggccaccgcgcgcgtcctcgtgcgaaacggcgtcgaggtgcgcgtgcccaaggatcagatctgctgcggcgcgctccaggtgcacgcgggcgatcgcgacatggcccgcgagatggcgaagcgaaacatcgaggtgtttgagcgcgcgggcgccgattacgtcgccatcaacgcggccggctgcggcgccgcgctgaaggaatacccggagctcttccgcgacgacccggcctggcgggatcgcgccgtgcagttctcgtcccgcgtgcgcgacatctctcagctcctcgtcgaggtcggcttcgatccgccgaaggccgagctgcccatggccgtcacgtaccacgacgcgtgccacctgttccacgcgcagaagatccggtacgagccgcgatcgctgctcaagtcggtgccgggcctgacgctttgcgagatgccggattccgaccgatgctgtggcagcgcgggcatctacaacctcacgcacccggcgatggctaacgagcttctcgagcgcaagatggacgacgtgcccgagggcgtggacgccatcgtcatggggaaccccggttgcatgatgcagatccggattggcgtcaagcgcaggaaccagccattgcgcgtcatgcacacggtcgaagtgctcgatctcgcctaccggagggagggatcgcgatga

SEQ ID NO: 646 - DNA, 1329 bp, Artificial
  Substituion in SEQ ID NO 631
atggtgaacgagcccacggccgtcgctgcgaaagggtccgattttcgctttccggacgcgcccgaggaagagaagtactcggtctgcgtgcattgcggcttctgcctggaggtgtgtccgacgtatcaggcgtggggcgacgagaatcattcgccccgcgggcgcgtgtacctgatcaaagcgtgcgcagaaggcgagcttccgctcgacgagagcgtgatcgatcccgtcttcacctgcctcgactgccgggcctgcgagaccgtgtgcccgtctggcgtgcaggtgggggcgctcgtcgaggaggcgcgcggccaggtgttttacgcgcgcgacgcggaagggaagcgggaccccgtcatgcgcttcttcctgcgcggcgtgtttccgcgcccggcgcgccttcggatcatccgacgtctcatgcggttctatcagaagtcggggctccagaaactggcgcgatcgaccggcgtcctgcgcgtgctgccgccgcaggtgcgcgagatggaggacgtcatcccggaaatcggacgggggcccgccatcgacgtcctgccggaaacgatagccccgcaaggggagcgcaaggccacggcggcgcttttcacgggctgcgtgatggacgtgttcttctccgacgtgaacgaggccaccgcgcgcgtcctcgtgcgaaacggcgtcgaggtgaaagtgcccaaggatcagatctgctgcggcgcgctccaggtgcacgcgggcgatcgcgacatggcccgcgagatggcgaagcgaaacatcgaggtgtttgagcgcgcgggcgccgattacgtcgccatcaacgcggccggctgcggcgccgcgctgaaggaatacccggagctcttccgcgacgacccggcctggcgggatcgcgccgtgcagttctcgtcccgcgtgcgcgacatctctcagctcctcgtcgaggtcggcttcgatccgccgaaggccgagctgcccatggccgtcacgtaccacgacgcgtgccacctgttccacgcgcagaagatccggtacgagccgcgatcgctgctcaagtcggtgccgggcctgacgctttgcgagatgccggattccgaccgatgctgtggcagcgcgggcatctacaacctcacgcacccggcgatggctaacgagcttctcgagcgcaagatggacgacgtgcccgagggcgtggacgccatcgtcatggggaaccccggttgcatgatgcagatccggctcggcgtcaagcgcaggaaccagccattgcgcgtcatgcacacggtcgaagtgctcgatctcgcctaccggagggagggatcgcgatga

SEQ ID NO: 647 - protein, 544 aa, Alicyclobacillus acidocaldarius
MHDADPARRQAQEPAIARHAHGRSARSRLPEGGIAMRDVHIDRLVEIVGERRCLWRPHQVKAYACDGYTAEEGLPRAVVFPESTDEVARICRYLYENDIPYLPRGAGTGLSGGATPTGGEVVISLARMNKLLAVDFDNLRAVVQPGLVNLTLTRRVSHADCYYAPDPSSQSVCTIGGNFAENAGGSHCLKYGVTTNHVVAAKVVLPDGDVIDVGAPFGDAPGYDLLGLLVGSEGTLGIATEITVRILKKPQALRTALAYFDRVADASDTVTDIIGAGIIPAAIEMMDQLAMQAVDKSNYHVGYPTDIEAVLLIEVDGLAAGVDEVMARVVEICRRHRVREVRVAQSDAERALWWSSRKMAFGAMGRISPDYIVQDGVIPRTRLTEVLQKIDEVSRRYGLKIANVFHAGDGNLHPLILYDSRVPGEAERAVRAGSEVLRACVDAGGSITGEHGVGIEKIGEMAYMFSEDEIHAQRAVKSCFDPKGIVNAGKLIPLPGRCVEVKRAREIIEENWQILNSFPDQAAVQARGAFVQEPGREASTSAQG

SEQ ID NO: 648 - DNA, 1635 bp, Alicyclobacillus acidocaldarius
ttgcatgatgcagatccggctcggcgtcaagcgcaggaaccagccattgcgcgtcatgcacacggtcgaagtgctcgatctcgcctaccggagggagggatcgcgatgagggacgtccacatcgacaggctcgtcgagatcgtcggcgagcggcgctgcctgtggcgaccgcaccaggtgaaggcgtacgcctgcgacggctacacggccgaagaggggctgccgcgcgcggtggtcttcccggagtcgacggacgaggtggcgcgcatctgccgctatctctacgagaacgacattccgtatcttccgcgcggcgcgggcacgggcctgtcgggcggcgccacgccgacggggggcgaggtcgtcatcagcctcgcgcgcatgaacaagctcctcgccgtcgacttcgacaacctgcgcgccgtcgtgcagcctgggctcgtgaacctcacgctcacgcgccgggtctcgcacgcggactgctactacgcgcccgatccgtccagccagtcggtctgcaccatcggcgggaacttcgcggagaacgcgggcggtagccactgcctgaagtacggcgtgaccacgaaccacgtggtcgcggccaaggtggtgctgccggatggcgacgtgatcgacgtcggcgcgccgttcggcgacgcgccggggtacgatctgctggggcttctggtcggctcggaggggacgctcggcatcgcgacggagatcacggtccgcatcctcaaaaagccgcaggcgctccgcaccgcgctcgcctacttcgatcgcgtcgccgacgcgtccgacacggtgacggacatcatcggggcgggcatcatcccggccgccatcgagatgatggatcagctcgcgatgcaggccgtcgacaagagcaactatcatgttggctatccgacggacatcgaggcggttttgctcatcgaggtggacggcctcgccgcgggcgtcgacgaggtgatggcgcgcgtggtggaaatttgccgccgccaccgcgtgcgcgaggtgcgggtggcgcagtcggacgccgagcgcgcgctctggtggtccagccgcaaaatggcgtttggcgccatggggcgcatctcgcccgactacatcgtgcaggacggcgtgattccgcgcacgcgcctcaccgaggtgctgcagaagatcgacgaggtgagccggcgatacgggctgaagatcgcgaacgtgtttcacgcgggcgacggcaacctgcatccgctcatcctgtacgacagccgcgtgccgggcgaggccgagcgcgcggtcagggccggatcggaggtgctgcgggcgtgcgtcgacgcgggcgggagcatcaccggcgagcacggcgtcggcattgagaagatcggcgaaatggcctatatgttttccgaggacgagatccatgcgcaacgcgcggtcaagtcctgcttcgatccgaagggcatcgtgaacgctgggaagctcattccgctgcccggccggtgcgtcgaggtgaagcgggcgcgcgagatcatcgaggagaattggcagattctcaactcgttcccggatcaggcggccgtgcaggcgcggggcgcctttgtgcaggagcccggcagagaagcatcgacgagcgcgcaaggatga

SEQ ID NO: 649 - protein, 470 aa, Geobacillus kaustophilus HTA426
IATNDPHIQALARIVGEQAILYRKEDLMAYDCDGFTVHRHLPRAVVFPNSTEQVAAVVKYCHEHDLPFLARGAGTGLSGGAIPLNGEVVISLTRMKRLLHVDLENRRAVVEPGFVNLKLTNSVAHRGYYYAPDPSSQYCCTIGGNVAENAGGAHCLKYGVTTNHILGLEVVLPNGEVIEIGGNGVPDPPGYDLLGLLTGSEGTLGIVTKITVRLLKNPEAKQTVLAYFDEVEDASQTVSDIISAGIVPAALEMMDQTAIEAVEAAAFPVGHPKDIAALLLIEVDGISAGIDEQINDILTICRRHHVREVKVAQSEEERARWWANRKTGFGAMGAISPDYLVQDGVIPRSRLPEVLREIADISRKYGLRIANIFHAGDGNLHPLVLFDASKPGETERALAAGSECLKACAAVGGSITGEHGVGIEKKEEMRFIFTDEEILAQTAIRDVFNPKNLLNAGKLFPTPERCVETK

SEQ ID NO: 650 - protein, 477 aa, Geobacillus thermodenitrificans NG80-2
IATNDPHIRALARIVGEEAILYRKEDLIAYDCDGFTVHRHLPKAVVFPNSTEEVAAVVKYCHEHELPFLARGAGTGLSGGAIPLNGEVIISLTRMKRLLHVDLENRRAVVEPGFVNLKLTNSVAHRGYYYAPDPSSQYCCTIGGNVAENAGGAHCLKYGVTTNHILGLEVVLPDGEVIEIGGNGVPDPPGYDLLGLLTGSEGTLGIVTKITVRLLKNPEAKQTVLAYFDEVEDASQTVSDIISAGIVPAALEMMDQTAIEAVEAAAFPVGHPKDIAALLLIEVDGISAGISEQIDDILTICRRHHVREVKVAESEEERARWWANRKTGFGAMGAISPDYLVQDGVIPRSRLPEVLREIANISRKYGLRIANIFHAGDGNLHPLVLFDASQPGETERALAAGSECLKACAAVGGSITGEHGVGLEKKEEMRFIFSDEEILAQTAIRDVFNPKNLLNAGKLFPTPGRCVETKQVSSTVK

SEQ ID NO: 651 - protein, 472 aa, Bacillus clausii KSM-K16
IKTNDPDILNLAKLVDGPKSILYLKEDLIAYDCDGFTIHKHLPKAVVFPKNTEEVAKIVNYCASHDLPFLARGAGTGLSGGAIPINGEVIISMVRMKRLISVDLENRRAVVEPGYVNLKLTNMIADKGYYYAPDPSSQSCCTIGGNVAENAGGAHCLKYGVTTNHILGLEVVLPNGDIIDINCEGIADVPGYDLLGLLTGSEGTLGIVTKITVRILKNPEAKQTVLAYFDEVSDGSYAVSDIVSAGIVPAALEMMDKTAIEGVEAAAFPVGHPRDIAALLLIEVDGISAGIDEQINQILDICKRRHVREVKVAENEQERARWWANRKTGFGAMGAISADYLVQDGVIPRSKLPEVLERINQISEQFGLRIANIFHAGDGNLHPLVLFDARIPGETEKALEAGSACLKACADVGGSITGEHGVGIEKMEEMRFVFNEEELAAQTRIREVFNPDNLLNGGKLFPSPGRCVEVKK

SEQ ID NO: 652 - protein, 462 aa, Gloeobacter violaceus PCC 7421
QMEQIVGKSGVVWTPEELLVFECDGLTSYKQRPALAVLPRTTEEVSRVLALCYREGLPFVARGSGTGLSGGALPVEGCVLVVTARMNRILAVDLDNRQVVVQPGVINNWVTQAVSGAGFYYAPDPSSQSICSIGGNVAENSGGVHCLKYGVTTNHVLGLKLVLPDGEVVDVGGRVPETPGYDLAGVFVGSEGTLGIATEITLRLLKSAESIRVLLADFAAIEEAGAAVTAIIAAGIVPGGMEIMDNLSINAVEDVVATDCYPRDAGAILLVEVDGLAVEVEAASARVEALCLEAGARAVRTATDPAERLKLWKGRKAAFAAMGQRAPNYYVQDGVIPRTKLQFVLQQIELLSEKHGYPVANVFHAGDGNLHPLILYDGRIAGELEKVELLGGEILKLCVAVGGSISGEHGIGAEKRCYMSDMFTPADLETMQWVRTVFDPKGLANPTKLFPTPRTCGEAARA

SEQ ID NO: 653 - protein, 465 aa, Microcystis aeruginosa NIES-843
IKQLEAILGKDGVIRRKDELLTYECDGITGYRQRPALVVLPRSTAEIAAVVKLCHDNEIAWVARGAGTGLSGGALPLEEGILIVTARMNQILRVDLDNQRVVVQPGVINNWVTQAVSGAGFYYAPDPSSQIICSIGGNVAENSGGVHCLKYGVTTNHVMGLKIVLPDGSIIDVGGAVPEQPGYDLTGLFVGSEGTLGIATEITLRILKTPESICVLLADFTSIEAAGQAVADIIKSGMIPAGMEIMDNLSINAVEDVVATGCYPRDAESVLLVELDGLGVEVTRNKHRVAEICRQNGARNITTANDAETRLKLWKGRKAAFAAAGKISPNYFVQDGVIPRTQLVYVLQEIKALSEKYGYKIANVFHAGDGNLHPLILYDNKVEGAWEEVEELGGEILKLCVRVGGSLSGEHGIGIDKNCYMPAMFNEIDLETMGYVRDCFNPKGLANPGKLFPTPRSCGEAANAK

SEQ ID NO: 654 - protein, 544 aa, Artificial
  Substituion in SEQ ID NO 647
MHDADPARRQAQEPAIARHAHGRSARSRLPEGGIAMRDVHIDRLVEIVGERRCLWRPHQVKAYACDGYTAEEGLPRAVVFPESTDEVARICRYLYENDIPYLPRGAGTGLSGGATPTGGEVVISLARMNKLLAVDFDNLRAVVQPGLVNLTLTRRVSHADCYYAPDPSSQSVCTIGGNFAENAGGSHCLKYGVTTNHVVAAKVVLPDGDVIDVGAPFGDAPGYDLLGLLVGSEGTLGIATEITVRILKKPQALRTALAYFDRVADASDTVTDIIGAGIIPAAIEMMDQLAMQAVDKSNYHVGYPTDIEAVLLIEVDGLAAGVDEVMARVIEICRRHRVREVRVAQSDAERALWWSSRKMAFGAMGRISPDYIVQDGVIPRTRLTEVLQKIDEVSRRYGLKIANVFHAGDGNLHPLILYDSRVPGEAERAVRAGSEVLRACVDAGGSITGEHGVGIEKIGEMAYMFSEDEIHAQRAVKSCFDPKGIVNAGKLIPLPGRCVEVKRAREIIEENWQILNSFPDQAAVQARGAFVQEPGREASTSAQG

SEQ ID NO: 655 - protein, 544 aa, Artificial
  Substituion in SEQ ID NO 647
MHDADPARRQAQEPAIARHAHGRSARSRLPEGGIAMRDVHIDRLVEIVGERRCLWRPHQVKAYACDGYTAEEGLPRAVVFPESTDEVARICRYLYENDIPYLPRGAGTGLSGGATPTGGEVVISLARMNKLLAVDFDNLRAVVQPGLVNLTLTRRVSHADCYYAPDPSSQSVCTIGGNFAENAGGSHCLKYGVTTNHVVAAKVVLPDGDVIDVGAPFGDAPGYDLLGLLVGSEGTLGIATEITVRILKKPQALRTALAYFDRVADASDTVTDIIGAGIIPAAIEMMDQLAMQAVDKSNYHVGYPTDIEAVLLIEVDGLAAGVDEVMARVVEICRRHRVREVKVAQSDAERALWWSSRKMAFGAMGRISPDYIVQDGVIPRTRLTEVLQKIDEVSRRYGLKIANVFHAGDGNLHPLILYDSRVPGEAERAVRAGSEVLRACVDAGGSITGEHGVGIEKIGEMAYMFSEDEIHAQRAVKSCFDPKGIVNAGKLIPLPGRCVEVKRAREIIEENWQILNSFPDQAAVQARGAFVQEPGREASTSAQG

SEQ ID NO: 656 - protein, 544 aa, Artificial
  Substituion in SEQ ID NO 647
MHDADPARRQAQEPAIARHAHGRSARSRLPEGGIAMRDVHIDRLVEIVGERRCLWRPHQVKAYACDGYTAEEGLPRAVVFPESTDEVARICRYLYENDIPYLPRGAGTGLSGGATPTGGEVVISLARMNKLLAVDFDNLRAVVQPGLVNLTLTRRVSHADCYYAPDPSSQSVCTIGGNFAENAGGSHCLKYGVTTNHVVAAKVVLPDGDVIDVGAPFGDAPGYDLLGLLVGSEGTLGIATEITVRILKKPQALRTALAYFDRVADASDTVTDIIGAGIIPAAIEMMDQLAMQAVDKSNYHVGYPTDIEAVLLIEVDGLAAGVDEVMARVVEICRRHRVREVRVAQSDAERALWWSSRKMAFGAMGRISPDYIVQDGVIPRTRLTEVLQKIDEVSRRYGLKIANVFHAGDGNLHPLILYDSRVPGEAERAVRAGSEVLRACVDAGGSITGEHGVGIEKIGEMAYMFSEDEIHAQRAVKSCFDPKGIVNAGKLIPLPGRCVEVKRAREIIEENWQILNSFPDNAAVQARGAFVQEPGREASTSAQG

SEQ ID NO: 657 - protein, 544 aa, Artificial
  Substituion in SEQ ID NO 647
MHDADPARRQAQEPAIARHAHGRSARSRLPEGGIAMRDVHIDRLVEIVGERRCLWRPHQVKAYACDGYTAEEGLPRAVVFPESTDEVARICRYLYENDIPYLPRGAGTGLSGGATPTGGEVVISLARMNKLLAVDFDNLRAVVQPGLVNLTLTRRVSHADCYYAPDPSSQSVCTIGGNFAENAGGSHCLKYGVTTNHVVAAKVVLPDGDVIDVGAPFGDAPGYDLLGLLVGSEGTLGIATEITVRILKKPQALRTALAYFDRVADASDTVTDIIGAGIIPAAIEMMDQLAMQAVDKSNYHVGYPTDIEAVLLIEVDGLAAGVDEVMARVVEICRRHRVREVRVANSDAERALWWSSRKMAFGAMGRISPDYIVQDGVIPRTRLTEVLQKIDEVSRRYGLKIANVFHAGDGNLHPLILYDSRVPGEAERAVRAGSEVLRACVDAGGSITGEHGVGIEKIGEMAYMFSEDEIHAQRAVKSCFDPKGIVNAGKLIPLPGRCVEVKRAREIIEENWQILNSFPDQAAVQARGAFVQEPGREASTSAQG

SEQ ID NO: 658 - protein, 544 aa, Artificial
  Substituion in SEQ ID NO 647
MHDADPARRQAQEPAIARHAHGRSARSRLPEGGLAMRDVHIDRLVEIVGERRCLWRPHQVKAYACDGYTAEEGLPRAVVFPESTDEVARICRYLYENDIPYLPRGAGTGLSGGATPTGGEVVISLARMNKLLAVDFDNLRAVVQPGLVNLTLTRRVSHADCYYAPDPSSQSVCTIGGNFAENAGGSHCLKYGVTTNHVVAAKVVLPDGDVIDVGAPFGDAPGYDLLGLLVGSEGTLGIATEITVRILKKPQALRTALAYFDRVADASDTVTDIIGAGIIPAAIEMMDQLAMQAVDKSNYHVGYPTDIEAVLLIEVDGLAAGVDEVMARVVEICRRHRVREVRVAQSDAERALWWSSRKMAFGAMGRISPDYIVQDGVIPRTRLTEVLQKIDEVSRRYGLKIANVFHAGDGNLHPLILYDSRVPGEAERAVRAGSEVLRACVDAGGSITGEHGVGIEKIGEMAYMFSEDEIHAQRAVKSCFDPKGIVNAGKLIPLPGRCVEVKRAREIIEENWQILNSFPDQAAVQARGAFVQEPGREASTSAQG

SEQ ID NO: 659 - DNA, 1635 bp, Artificial
  Substituion in SEQ ID NO 648
ttgcatgatgcagatccggctcggcgtcaagcgcaggaaccagccattgcgcgtcatgcacacggtcgaagtgctcgatctcgcctaccggagggagggatcgcgatgagggacgtccacatcgacaggctcgtcgagatcgtcggcgagcggcgctgcctgtggcgaccgcaccaggtgaaggcgtacgcctgcgacggctacacggccgaagaggggctgccgcgcgcggtggtcttcccggagtcgacggacgaggtggcgcgcatctgccgctatctctacgagaacgacattccgtatcttccgcgcggcgcgggcacgggcctgtcgggcggcgccacgccgacggggggcgaggtcgtcatcagcctcgcgcgcatgaacaagctcctcgccgtcgacttcgacaacctgcgcgccgtcgtgcagcctgggctcgtgaacctcacgctcacgcgccgggtctcgcacgcggactgctactacgcgcccgatccgtccagccagtcggtctgcaccatcggcgggaacttcgcggagaacgcgggcggtagccactgcctgaagtacggcgtgaccacgaaccacgtggtcgcggccaaggtggtgctgccggatggcgacgtgatcgacgtcggcgcgccgttcggcgacgcgccggggtacgatctgctggggcttctggtcggctcggaggggacgctcggcatcgcgacggagatcacggtccgcatcctcaaaaagccgcaggcgctccgcaccgcgctcgcctacttcgatcgcgtcgccgacgcgtccgacacggtgacggacatcatcggggcgggcatcatcccggccgccatcgagatgatggatcagctcgcgatgcaggccgtcgacaagagcaactatcatgttggctatccgacggacatcgaggcggttttgctcatcgaggtggacggcctcgccgcgggcgtcgacgaggtgatggcgcgcgtgattgaaatttgccgccgccaccgcgtgcgcgaggtgcgggtggcgcagtcggacgccgagcgcgcgctctggtggtccagccgcaaaatggcgtttggcgccatggggcgcatctcgcccgactacatcgtgcaggacggcgtgattccgcgcacgcgcctcaccgaggtgctgcagaagatcgacgaggtgagccggcgatacgggctgaagatcgcgaacgtgtttcacgcgggcgacggcaacctgcatccgctcatcctgtacgacagccgcgtgccgggcgaggccgagcgcgcggtcagggccggatcggaggtgctgcgggcgtgcgtcgacgcgggcgggagcatcaccggcgagcacggcgtcggcattgagaagatcggcgaaatggcctatatgttttccgaggacgagatccatgcgcaacgcgcggtcaagtcctgcttcgatccgaagggcatcgtgaacgctgggaagctcattccgctgcccggccggtgcgtcgaggtgaagcgggcgcgcgagatcatcgaggagaattggcagattctcaactcgttcccggatcaggcggccgtgcaggcgcggggcgcctttgtgcaggagcccggcagagaagcatcgacgagcgcgcaaggatga

SEQ ID NO: 660 - DNA, 1635 bp, Artificial
  Substituion in SEQ ID NO 648
ttgcatgatgcagatccggctcggcgtcaagcgcaggaaccagccattgcgcgtcatgcacacggtcgaagtgctcgatctcgcctaccggagggagggatcgcgatgagggacgtccacatcgacaggctcgtcgagatcgtcggcgagcggcgctgcctgtggcgaccgcaccaggtgaaggcgtacgcctgcgacggctacacggccgaagaggggctgccgcgcgcggtggtcttcccggagtcgacggacgaggtggcgcgcatctgccgctatctctacgagaacgacattccgtatcttccgcgcggcgcgggcacgggcctgtcgggcggcgccacgccgacggggggcgaggtcgtcatcagcctcgcgcgcatgaacaagctcctcgccgtcgacttcgacaacctgcgcgccgtcgtgcagcctgggctcgtgaacctcacgctcacgcgccgggtctcgcacgcggactgctactacgcgcccgatccgtccagccagtcggtctgcaccatcggcgggaacttcgcggagaacgcgggcggtagccactgcctgaagtacggcgtgaccacgaaccacgtggtcgcggccaaggtggtgctgccggatggcgacgtgatcgacgtcggcgcgccgttcggcgacgcgccggggtacgatctgctggggcttctggtcggctcggaggggacgctcggcatcgcgacggagatcacggtccgcatcctcaaaaagccgcaggcgctccgcaccgcgctcgcctacttcgatcgcgtcgccgacgcgtccgacacggtgacggacatcatcggggcgggcatcatcccggccgccatcgagatgatggatcagctcgcgatgcaggccgtcgacaagagcaactatcatgttggctatccgacggacatcgaggcggttttgctcatcgaggtggacggcctcgccgcgggcgtcgacgaggtgatggcgcgcgtggtggaaatttgccgccgccaccgcgtgcgcgaggtgaaagtggcgcagtcggacgccgagcgcgcgctctggtggtccagccgcaaaatggcgtttggcgccatggggcgcatctcgcccgactacatcgtgcaggacggcgtgattccgcgcacgcgcctcaccgaggtgctgcagaagatcgacgaggtgagccggcgatacgggctgaagatcgcgaacgtgtttcacgcgggcgacggcaacctgcatccgctcatcctgtacgacagccgcgtgccgggcgaggccgagcgcgcggtcagggccggatcggaggtgctgcgggcgtgcgtcgacgcgggcgggagcatcaccggcgagcacggcgtcggcattgagaagatcggcgaaatggcctatatgttttccgaggacgagatccatgcgcaacgcgcggtcaagtcctgcttcgatccgaagggcatcgtgaacgctgggaagctcattccgctgcccggccggtgcgtcgaggtgaagcgggcgcgcgagatcatcgaggagaattggcagattctcaactcgttcccggatcaggcggccgtgcaggcgcggggcgcctttgtgcaggagcccggcagagaagcatcgacgagcgcgcaaggatga

SEQ ID NO: 661 - DNA, 1635 bp, Artificial
  Substituion in SEQ ID NO 648
ttgcatgatgcagatccggctcggcgtcaagcgcaggaaccagccattgcgcgtcatgcacacggtcgaagtgctcgatctcgcctaccggagggagggatcgcgatgagggacgtccacatcgacaggctcgtcgagatcgtcggcgagcggcgctgcctgtggcgaccgcaccaggtgaaggcgtacgcctgcgacggctacacggccgaagaggggctgccgcgcgcggtggtcttcccggagtcgacggacgaggtggcgcgcatctgccgctatctctacgagaacgacattccgtatcttccgcgcggcgcgggcacgggcctgtcgggcggcgccacgccgacggggggcgaggtcgtcatcagcctcgcgcgcatgaacaagctcctcgccgtcgacttcgacaacctgcgcgccgtcgtgcagcctgggctcgtgaacctcacgctcacgcgccgggtctcgcacgcggactgctactacgcgcccgatccgtccagccagtcggtctgcaccatcggcgggaacttcgcggagaacgcgggcggtagccactgcctgaagtacggcgtgaccacgaaccacgtggtcgcggccaaggtggtgctgccggatggcgacgtgatcgacgtcggcgcgccgttcggcgacgcgccggggtacgatctgctggggcttctggtcggctcggaggggacgctcggcatcgcgacggagatcacggtccgcatcctcaaaaagccgcaggcgctccgcaccgcgctcgcctacttcgatcgcgtcgccgacgcgtccgacacggtgacggacatcatcggggcgggcatcatcccggccgccatcgagatgatggatcagctcgcgatgcaggccgtcgacaagagcaactatcatgttggctatccgacggacatcgaggcggttttgctcatcgaggtggacggcctcgccgcgggcgtcgacgaggtgatggcgcgcgtggtggaaatttgccgccgccaccgcgtgcgcgaggtgcgggtggcgcagtcggacgccgagcgcgcgctctggtggtccagccgcaaaatggcgtttggcgccatggggcgcatctcgcccgactacatcgtgcaggacggcgtgattccgcgcacgcgcctcaccgaggtgctgcagaagatcgacgaggtgagccggcgatacgggctgaagatcgcgaacgtgtttcacgcgggcgacggcaacctgcatccgctcatcctgtacgacagccgcgtgccgggcgaggccgagcgcgcggtcagggccggatcggaggtgctgcgggcgtgcgtcgacgcgggcgggagcatcaccggcgagcacggcgtcggcattgagaagatcggcgaaatggcctatatgttttccgaggacgagatccatgcgcaacgcgcggtcaagtcctgcttcgatccgaagggcatcgtgaacgctgggaagctcattccgctgcccggccggtgcgtcgaggtgaagcgggcgcgcgagatcatcgaggagaattggcagattctcaactcgttcccggataatgcggccgtgcaggcgcggggcgcctttgtgcaggagcccggcagagaagcatcgacgagcgcgcaaggatga

SEQ ID NO: 662 - DNA, 1635 bp, Artificial
  Substituion in SEQ ID NO 648
ttgcatgatgcagatccggctcggcgtcaagcgcaggaaccagccattgcgcgtcatgcacacggtcgaagtgctcgatctcgcctaccggagggagggatcgcgatgagggacgtccacatcgacaggctcgtcgagatcgtcggcgagcggcgctgcctgtggcgaccgcaccaggtgaaggcgtacgcctgcgacggctacacggccgaagaggggctgccgcgcgcggtggtcttcccggagtcgacggacgaggtggcgcgcatctgccgctatctctacgagaacgacattccgtatcttccgcgcggcgcgggcacgggcctgtcgggcggcgccacgccgacggggggcgaggtcgtcatcagcctcgcgcgcatgaacaagctcctcgccgtcgacttcgacaacctgcgcgccgtcgtgcagcctgggctcgtgaacctcacgctcacgcgccgggtctcgcacgcggactgctactacgcgcccgatccgtccagccagtcggtctgcaccatcggcgggaacttcgcggagaacgcgggcggtagccactgcctgaagtacggcgtgaccacgaaccacgtggtcgcggccaaggtggtgctgccggatggcgacgtgatcgacgtcggcgcgccgttcggcgacgcgccggggtacgatctgctggggcttctggtcggctcggaggggacgctcggcatcgcgacggagatcacggtccgcatcctcaaaaagccgcaggcgctccgcaccgcgctcgcctacttcgatcgcgtcgccgacgcgtccgacacggtgacggacatcatcggggcgggcatcatcccggccgccatcgagatgatggatcagctcgcgatgcaggccgtcgacaagagcaactatcatgttggctatccgacggacatcgaggcggttttgctcatcgaggtggacggcctcgccgcgggcgtcgacgaggtgatggcgcgcgtggtggaaatttgccgccgccaccgcgtgcgcgaggtgcgggtggcgaattcggacgccgagcgcgcgctctggtggtccagccgcaaaatggcgtttggcgccatggggcgcatctcgcccgactacatcgtgcaggacggcgtgattccgcgcacgcgcctcaccgaggtgctgcagaagatcgacgaggtgagccggcgatacgggctgaagatcgcgaacgtgtttcacgcgggcgacggcaacctgcatccgctcatcctgtacgacagccgcgtgccgggcgaggccgagcgcgcggtcagggccggatcggaggtgctgcgggcgtgcgtcgacgcgggcgggagcatcaccggcgagcacggcgtcggcattgagaagatcggcgaaatggcctatatgttttccgaggacgagatccatgcgcaacgcgcggtcaagtcctgcttcgatccgaagggcatcgtgaacgctgggaagctcattccgctgcccggccggtgcgtcgaggtgaagcgggcgcgcgagatcatcgaggagaattggcagattctcaactcgttcccggatcaggcggccgtgcaggcgcggggcgcctttgtgcaggagcccggcagagaagcatcgacgagcgcgcaaggatga

SEQ ID NO: 663 - DNA, 1635 bp, Artificial
  Substituion in SEQ ID NO 648
ttgcatgatgcagatccggctcggcgtcaagcgcaggaaccagccattgcgcgtcatgcacacggtcgaagtgctcgatctcgcctaccggagggagggttagcgatgagggacgtccacatcgacaggctcgtcgagatcgtcggcgagcggcgctgcctgtggcgaccgcaccaggtgaaggcgtacgcctgcgacggctacacggccgaagaggggctgccgcgcgcggtggtcttcccggagtcgacggacgaggtggcgcgcatctgccgctatctctacgagaacgacattccgtatcttccgcgcggcgcgggcacgggcctgtcgggcggcgccacgccgacggggggcgaggtcgtcatcagcctcgcgcgcatgaacaagctcctcgccgtcgacttcgacaacctgcgcgccgtcgtgcagcctgggctcgtgaacctcacgctcacgcgccgggtctcgcacgcggactgctactacgcgcccgatccgtccagccagtcggtctgcaccatcggcgggaacttcgcggagaacgcgggcggtagccactgcctgaagtacggcgtgaccacgaaccacgtggtcgcggccaaggtggtgctgccggatggcgacgtgatcgacgtcggcgcgccgttcggcgacgcgccggggtacgatctgctggggcttctggtcggctcggaggggacgctcggcatcgcgacggagatcacggtccgcatcctcaaaaagccgcaggcgctccgcaccgcgctcgcctacttcgatcgcgtcgccgacgcgtccgacacggtgacggacatcatcggggcgggcatcatcccggccgccatcgagatgatggatcagctcgcgatgcaggccgtcgacaagagcaactatcatgttggctatccgacggacatcgaggcggttttgctcatcgaggtggacggcctcgccgcgggcgtcgacgaggtgatggcgcgcgtggtggaaatttgccgccgccaccgcgtgcgcgaggtgcgggtggcgcagtcggacgccgagcgcgcgctctggtggtccagccgcaaaatggcgtttggcgccatggggcgcatctcgcccgactacatcgtgcaggacggcgtgattccgcgcacgcgcctcaccgaggtgctgcagaagatcgacgaggtgagccggcgatacgggctgaagatcgcgaacgtgtttcacgcgggcgacggcaacctgcatccgctcatcctgtacgacagccgcgtgccgggcgaggccgagcgcgcggtcagggccggatcggaggtgctgcgggcgtgcgtcgacgcgggcgggagcatcaccggcgagcacggcgtcggcattgagaagatcggcgaaatggcctatatgttttccgaggacgagatccatgcgcaacgcgcggtcaagtcctgcttcgatccgaagggcatcgtgaacgctgggaagctcattccgctgcccggccggtgcgtcgaggtgaagcgggcgcgcgagatcatcgaggagaattggcagattctcaactcgttcccggatcaggcggccgtgcaggcgcggggcgcctttgtgcaggagcccggcagagaagcatcgacgagcgcgcaaggatga

SEQ ID NO: 664 - protein, 534 aa, Alicyclobacillus acidocaldarius
MAGSYACPQGVQITGEYRPEFAEILTTDALQFIAELERRFGPRRDELLRLRKERDERLLAGEWPDFLPETKEIRESEWTVGPIPADLQDRRVEITGPSSDRKMVINALNSGAKCFMADFEDACAPSWENVVQGQINMRDAVRRTIEYTSPEGKHYKLNDEVAVLIVRPRGWHLPEKHIRVDGRVATGALVDFGLYFYHNAKELLARGTGPYFYLPKMESHLEARLWNDVFNYAQDALGIPRGTIKATVLIETILATFEMDEILYELRDHAAGLNCGRWDYIFSYIKKFRNHPEVILPDRAQVTMTVPFMRAYTLLTIRTCHRRKAFAMGGMAAQIPIKNDPKANEEALAKVRADKEREAQDGHDGTWVAHPGLVPVAMEVFNRLMPTPNQLHRLREDVQVTAADLVAVPQGTITEGGLRTNVAVALRYIEAWLRGSGAVPIFNLMEDAATAEISRAQIWQWIHHPKGVLDDGRKVTVELFRQILEEELRKLKDEIGEEAYAQSKFPLAAELLDDISTKDDFVDFLTLPGYEHLA

SEQ ID NO: 665 - DNA, 1605 bp, Alicyclobacillus acidocaldarius
atggcgggatcgtacgcttgcccacagggcgtgcaaatcacgggcgaatacaggcctgagttcgccgaaatcctcacgacggacgcgcttcaattcatcgcggagcttgagcgccgcttcggtccgaggcgggacgaactgcttcgcctgcgcaaggagcgggacgagcggttgctcgcgggcgaatggccggacttcttgccggagaccaaggagattcgcgagagcgagtggacggtcgggcccatccccgcggatctgcaggatcggcgcgtggaaatcacgggcccgagttcggaccggaagatggtcatcaacgccttgaactcgggcgccaagtgcttcatggcggactttgaggacgcctgcgcaccgtcctgggagaacgtcgtgcagggtcagatcaacatgcgggacgcagttcgccgcaccatcgaatacacgagccccgaggggaagcactacaagctgaatgacgaagttgcggtgctcatcgtgcgcccgcgcggctggcacctgcccgagaagcacatccgggtggacggccgggtggccacgggcgcgctcgtcgacttcgggctttacttctaccacaatgccaaggagcttttggcgcgcggcaccgggccctacttctacctgccgaagatggagagccacctcgaggcgaggctgtggaacgacgtgttcaactacgcccaggacgcgctcggcatcccgcgcggcaccatcaaggccactgtgctcatcgagaccatcctcgcgacgttcgagatggacgagatcctgtatgagctgcgcgatcacgccgcggggctcaactgcggccgctgggactacatcttcagctacatcaagaagttccgcaatcacccggaggtcatcctgcctgaccgggcgcaggtgacgatgacggtgccgttcatgcgcgcgtacaccctgctcaccatccgcacgtgccatcggcgcaaggcgttcgcgatgggcggcatggcggcgcagatccccatcaagaacgacccgaaggcgaacgaggaggcgctcgccaaggtgcgcgcggacaaggagcgcgaggcgcaggacggccacgacggcacctgggtggcgcacccgggtctcgtgcccgtggcgatggaggtgttcaatcgcctcatgcccacgcccaaccagttgcaccgcctgcgcgaggacgtccaggtcaccgcggccgatctcgtcgcggtcccgcagggcaccatcaccgaaggcggcctgcgcaccaacgtcgccgtggcgcttcgctacatcgaggcttggctgcgcggttccggcgcggtgcccatcttcaacctgatggaagacgcggcgacggcggagatctcccgcgcgcagatctggcagtggatccatcacccgaaaggcgtcctcgacgacggccgcaaggtgacggtggagctgttccggcagattctcgaagaggagttgcgcaagttgaaggacgagatcggcgaggaggcgtacgcacagagcaagttcccgctcgcggccgaacttctcgacgacatctcgacgaaggacgacttcgtcgacttcctgacgctgccgggttacgagcacctggcgtga

SEQ ID NO: 666 - protein, 525 aa, Chloroflexus aurantiacus J-10-fl
PAGVTITAPITPAYAEILTPEALEFLATLHRRFNTRRLELLARRAERQRAIDAGERPDFLPETAHIRESEWTIAPIPPQIQDRRVEITGPVDRKMIINALNSGAKVFMADFEDANTPTWQNQVEGQINLRDALRRTITYTSPEGKHYALNNNPAILFVRPRGWHLNEKHMLVDGEPISGAIFDFGLYFFHNAQTAIDVQGGPYFYLPKMESHLEARLWNDIFVLAQELRGIPQGTIKATVLIETILAAFEMDEILYELRNHSAGLNCGRWDYIFSCIKKFRNDPNFCLADRALVTMTTHFMRSYSLLAIKTCHRRGAHAMGGMAAQIPIKNDPVANEAALAKVRADKEREASDGHDGTWVAHPGLVPVAMEVFDRLMPTPNQINRQRDDVQVTAADLLAFGPEKPITEQGMRLNINVGIQYLGAWLAGNGCVPVFNLMEDAATAEISRAQIWQWIRSPKGVLEDGRKVTVELFRQMLPEELHKVREILGPAYEDGRYEEAAELFDEITTDPEFVEFLTLPAYERI

SEQ ID NO: 667 - protein, 525 aa, Chloroflexus aggregans DSM 9485
PAGVTITAPITPEYAEILTPEALEFLATLHRRFNARRLELLARRAERQRAIDAGERPDFLPETAHIRESDWTIAPFPPQLNDRRVEITGPVDRKMIINALNSGAKVFMADFEDANTPTWQNQIEGQINLRDALRRTITYTSPEGKYYALNPNPAILFVRPRGWHLPEKHMLVDGEPIAGAIFDFGLYFFHNAQTAIEVQGGPYFYLPKLESHLEARLWNDIFVLAQELRGIPRGTIKATVLIETILAAFEMDEILYELREHSAGLNCGRWDYIFSCIKKFRNDPNFCLADRVLVTMTTHFMRSYSLLAIKTCHRRGAHAMGGMAAQIPIKNDPVANEAALAKVRADKEREANDGHDGTWVAHPGLVPVAMEVFDRLMPTPNQINRQRDDVHVTAADLLAFGPSEPITEQGLRLNINVGIQYLGAWLAGNGCVPVFNLMEDAATAEISRAQIWQWIRSPKGVLADGRKVTVELFRQMLPEELAKVREILGPAYEDGRYGEAAELFDEITTDPNFVEFLTLPAYDRI

SEQ ID NO: 668 - protein, 524 aa, Bacillus coagulans 36D1
GITVTGSIHDGYDDILTPEALQFLEQLERHFGERRRELLAYRKKRDEEIKSGKLPHFLEETASIRESDWTIAPLPEDLQDRRVEITGPVDRKMVINALNSGAKIFMACFEDATSPTWENIIEGQIHLRDAVNRTITFTGPNGKEYKLADHPAVLIVRPRGWHLEEKHILVDGKPISGSLTDFGLYFFHNARRLLENSTGPYFYLPKMESHLEARLWNDVFIFAQKYIGIPKGTIKATVLIETIMAAFEMDEILYELKEHSAGLNCGRWDYIFSYIKKLRTNPQFITPDRSLVTMTVPFMRAYSLLTIKTCHRRNAPAIGGMAAQIPVKDDPAKNEEAFQKVRADKEREARDGHDGTWVAHPGLVPVALEAFNKEMPEPNQIHSGKQMDFTATADDLLAVPQGEITEKGIRENIYAGIQYIESWLRGRGAVPISNLMEDAATAEISRTQLWHWIRHPKGVLQDGRKVTIELYEQIKAEELERIRREIGEEYYRAGRFEEAVALFDRLVKEDEFIEFLTLPAYELL

SEQ ID NO: 669 - protein, 522 aa, Bacillus cereus subsp. cytotoxis NVH 391-98
VTLAGELLPSYNEILTPEALTFLKELHENFNERRIQLLKKREEKQKRIDAGEFPNFLPETAHIRAGNWTIAPLPRDLEDRRVEITGPVDRKMIINALNSGAHLFMADFEDSSSPTWKNIIEGQINLRDAAKGTISYKSPSGKEYRLGDQTAVLIVRPRGWHLEEKHMQVDGKRMSGSLVDFGLYFFHNAKTLIEKGSGPYFYLPKMESYLEARLWNDVFVFAQKYVGIPNGTIKATVLLETIHAAFEMDEILYELRDHSAGLNCGRWDYIFSFLKCFRNHKAFLLPDRAQVTMTVPFMRAYSLKVIQTCHRRNAPAMGGMAAQIPIKNNPEANEIAFEKVRVDKEREALDGHDGTWVAHPGLVPVAMEVFNHIMKTPNQIFRKREELHVTEKDLLEVPMGTITEEGLRMNISVGIQYIASWLSGRGAAPIYNLMEDAATAEISRAQVWQWIRHEEGKLNDGRKVTFALVEQLKAEELAKIEKEIGKESFEKGRFVEATKLFTDLVRKDEFEPFLTLPGYEIL

SEQ ID NO: 670 - protein, 522 aa, Bacillus cereus E33L
VTLVGEMLPAYNEILTPEALSFLKELHGNFNERRIELLQKRAEKQKRIDAGEFPKFLEETKHIREADWTIAKLPKDLEDRRVEITGPVDRKMVINALNSGAHLFMADFEDSNSPTWENAIEGQINLRDAVRGTISHKNENGKEYRLNSKTAVLIVRPRGWHLEEKHMQVDGKNMSGSLVDFGLYFFHNAKALLEKGSGPYFYLPKMESYLEARLWNDVFVFAQKYIGIPNGTIKATVLLETIHASFEMDEILYELKDHSAGLNCGRWDYIFSFLKAFRNHNEFLLPDRAQVTMTAPFMRAYSLKVIQTCHRRNAPAIGGMAAQIPIKNNPKANEAAFEKVRADKEREALDGHDGTWVAHPGLVPVAMEVFNHIMKTPNQIFRKREEIHVTEKDLLEVPVGTITEEGLRMNISVGIQYIASWLSGRGAAPIYNLMEDAATAEISRAQVWQWIRHEGGKLNDGRNITLELMEELKEEELEKIEREIGKEAFKKGRFQEATTLFTNLVRNDEFVPFLTLPGYEIL

SEQ ID NO: 671 - protein, 534 aa, Artificial
  Substituion in SEQ ID NO 664
MAGSYACPQGVQITGEYRPEFAEILTTDALQFIAELERRFGPRRDELLRLRKERDERLLAGEWPDFLPETKEIRESEWTVGPIPADLQDRRVEITGPSSDRKMVINALNSGAKCFMADFEDACAPSWENVVQGQINMRDAVRRTIEYTSPEGKHYKLNDEVAVLIVRPRGWHLPEKHIRVDGRVATGALVDFGLYFYHNAKELLARGTGPYFYLPKMESHLEARLWNDVFNYAQDALGIPRGTIKATVLIETILATFEMDEILYELRDHAAGLNCGRWDYIFSYIKKFRNHPEVILPDRAQVTMTVPFMRAYTLLTIRTCHRRKAFAMGGMAAQIPIKNDPKANEEALAKVRADKEREAQDGHDGTWVAHPGLVPVAMEVFNRLMPTPNQLHRLREDVQVTAADLVAVPQGTITEGGLRTNVAVALRYIEAWLRGSGAVPIFNLMEDAATAEISRAQIWQWIHHPKGVLDDGRKVTVELFRQILEEELRKLKDEIGEEAYAQSKFPLAAELLDEISTKDDFVDFLTLPGYEHLA

SEQ ID NO: 672 - protein, 534 aa, Artificial
  Substituion in SEQ ID NO 664
MAGSYACPQGVQITGDYRPEFAEILTTDALQFIAELERRFGPRRDELLRLRKERDERLLAGEWPDFLPETKEIRESEWTVGPIPADLQDRRVEITGPSSDRKMVINALNSGAKCFMADFEDACAPSWENVVQGQINMRDAVRRTIEYTSPEGKHYKLNDEVAVLIVRPRGWHLPEKHIRVDGRVATGALVDFGLYFYHNAKELLARGTGPYFYLPKMESHLEARLWNDVFNYAQDALGIPRGTIKATVLIETILATFEMDEILYELRDHAAGLNCGRWDYIFSYIKKFRNHPEVILPDRAQVTMTVPFMRAYTLLTIRTCHRRKAFAMGGMAAQIPIKNDPKANEEALAKVRADKEREAQDGHDGTWVAHPGLVPVAMEVFNRLMPTPNQLHRLREDVQVTAADLVAVPQGTITEGGLRTNVAVALRYIEAWLRGSGAVPIFNLMEDAATAEISRAQIWQWIHHPKGVLDDGRKVTVELFRQILEEELRKLKDEIGEEAYAQSKFPLAAELLDDISTKDDFVDFLTLPGYEHLA

SEQ ID NO: 673 - protein, 534 aa, Artificial
  Substituion in SEQ ID NO 664
MAGSYACPQGVQITGEYRPEFAEILTTDALQFIADLERRFGPRRDELLRLRKERDERLLAGEWPDFLPETKEIRESEWTVGPIPADLQDRRVEITGPSSDRKMVINALNSGAKCFMADFEDACAPSWENVVQGQINMRDAVRRTIEYTSPEGKHYKLNDEVAVLIVRPRGWHLPEKHIRVDGRVATGALVDFGLYFYHNAKELLARGTGPYFYLPKMESHLEARLWNDVFNYAQDALGIPRGTIKATVLIETILATFEMDEILYELRDHAAGLNCGRWDYIFSYIKKFRNHPEVILPDRAQVTMTVPFMRAYTLLTIRTCHRRKAFAMGGMAAQIPIKNDPKANEEALAKVRADKEREAQDGHDGTWVAHPGLVPVAMEVFNRLMPTPNQLHRLREDVQVTAADLVAVPQGTITEGGLRTNVAVALRYIEAWLRGSGAVPIFNLMEDAATAEISRAQIWQWIHHPKGVLDDGRKVTVELFRQILEEELRKLKDEIGEEAYAQSKFPLAAELLDDISTKDDFVDFLTLPGYEHLA

SEQ ID NO: 674 - protein, 534 aa, Artificial
  Substituion in SEQ ID NO 664
MAGSYACPQGVQITGEYRPEFAEILTTDALQFIAELERRFGPRRDELLRLRKERDERLLAGEWPDFLPETREIRESEWTVGPIPADLQDRRVEITGPSSDRKMVINALNSGAKCFMADFEDACAPSWENVVQGQINMRDAVRRTIEYTSPEGKHYKLNDEVAVLIVRPRGWHLPEKHIRVDGRVATGALVDFGLYFYHNAKELLARGTGPYFYLPKMESHLEARLWNDVFNYAQDALGIPRGTIKATVLIETILATFEMDEILYELRDHAAGLNCGRWDYIFSYIKKFRNHPEVILPDRAQVTMTVPFMRAYTLLTIRTCHRRKAFAMGGMAAQIPIKNDPKANEEALAKVRADKEREAQDGHDGTWVAHPGLVPVAMEVFNRLMPTPNQLHRLREDVQVTAADLVAVPQGTITEGGLRTNVAVALRYIEAWLRGSGAVPIFNLMEDAATAEISRAQIWQWIHHPKGVLDDGRKVTVELFRQILEEELRKLKDEIGEEAYAQSKFPLAAELLDDISTKDDFVDFLTLPGYEHLA

SEQ ID NO: 675 - protein, 534 aa, Artificial
  Substituion in SEQ ID NO 664
MAGSYACPQGVQITGEYRPEFAEILTTDALQFIAELERRFGPRRDELLRLRKERDERLIAGEWPDFLPETKEIRESEWTVGPIPADLQDRRVEITGPSSDRKMVINALNSGAKCFMADFEDACAPSWENVVQGQINMRDAVRRTIEYTSPEGKHYKLNDEVAVLIVRPRGWHLPEKHIRVDGRVATGALVDFGLYFYHNAKELLARGTGPYFYLPKMESHLEARLWNDVFNYAQDALGIPRGTIKATVLIETILATFEMDEILYELRDHAAGLNCGRWDYIFSYIKKFRNHPEVILPDRAQVTMTVPFMRAYTLLTIRTCHRRKAFAMGGMAAQIPIKNDPKANEEALAKVRADKEREAQDGHDGTWVAHPGLVPVAMEVFNRLMPTPNQLHRLREDVQVTAADLVAVPQGTITEGGLRTNVAVALRYIEAWLRGSGAVPIFNLMEDAATAEISRAQIWQWIHHPKGVLDDGRKVTVELFRQILEEELRKLKDEIGEEAYAQSKFPLAAELLDDISTKDDFVDFLTLPGYEHLA

SEQ ID NO: 676 - DNA, 1605 bp, Artificial
  Substituion in SEQ ID NO 665
atggcgggatcgtacgcttgcccacagggcgtgcaaatcacgggcgaatacaggcctgagttcgccgaaatcctcacgacggacgcgcttcaattcatcgcggagcttgagcgccgcttcggtccgaggcgggacgaactgcttcgcctgcgcaaggagcgggacgagcggttgctcgcgggcgaatggccggacttcttgccggagaccaaggagattcgcgagagcgagtggacggtcgggcccatccccgcggatctgcaggatcggcgcgtggaaatcacgggcccgagttcggaccggaagatggtcatcaacgccttgaactcgggcgccaagtgcttcatggcggactttgaggacgcctgcgcaccgtcctgggagaacgtcgtgcagggtcagatcaacatgcgggacgcagttcgccgcaccatcgaatacacgagccccgaggggaagcactacaagctgaatgacgaagttgcggtgctcatcgtgcgcccgcgcggctggcacctgcccgagaagcacatccgggtggacggccgggtggccacgggcgcgctcgtcgacttcgggctttacttctaccacaatgccaaggagcttttggcgcgcggcaccgggccctacttctacctgccgaagatggagagccacctcgaggcgaggctgtggaacgacgtgttcaactacgcccaggacgcgctcggcatcccgcgcggcaccatcaaggccactgtgctcatcgagaccatcctcgcgacgttcgagatggacgagatcctgtatgagctgcgcgatcacgccgcggggctcaactgcggccgctgggactacatcttcagctacatcaagaagttccgcaatcacccggaggtcatcctgcctgaccgggcgcaggtgacgatgacggtgccgttcatgcgcgcgtacaccctgctcaccatccgcacgtgccatcggcgcaaggcgttcgcgatgggcggcatggcggcgcagatccccatcaagaacgacccgaaggcgaacgaggaggcgctcgccaaggtgcgcgcggacaaggagcgcgaggcgcaggacggccacgacggcacctgggtggcgcacccgggtctcgtgcccgtggcgatggaggtgttcaatcgcctcatgcccacgcccaaccagttgcaccgcctgcgcgaggacgtccaggtcaccgcggccgatctcgtcgcggtcccgcagggcaccatcaccgaaggcggcctgcgcaccaacgtcgccgtggcgcttcgctacatcgaggcttggctgcgcggttccggcgcggtgcccatcttcaacctgatggaagacgcggcgacggcggagatctcccgcgcgcagatctggcagtggatccatcacccgaaaggcgtcctcgacgacggccgcaaggtgacggtggagctgttccggcagattctcgaagaggagttgcgcaagttgaaggacgagatcggcgaggaggcgtacgcacagagcaagttcccgctcgcggccgaacttctcgacgaaatctcgacgaaggacgacttcgtcgacttcctgacgctgccgggttacgagcacctggcgtga

SEQ ID NO: 677 - DNA, 1605 bp, Artificial
  Substituion in SEQ ID NO 665
atggcgggatcgtacgcttgcccacagggcgtgcaaatcacgggcgattacaggcctgagttcgccgaaatcctcacgacggacgcgcttcaattcatcgcggagcttgagcgccgcttcggtccgaggcgggacgaactgcttcgcctgcgcaaggagcgggacgagcggttgctcgcgggcgaatggccggacttcttgccggagaccaaggagattcgcgagagcgagtggacggtcgggcccatccccgcggatctgcaggatcggcgcgtggaaatcacgggcccgagttcggaccggaagatggtcatcaacgccttgaactcgggcgccaagtgcttcatggcggactttgaggacgcctgcgcaccgtcctgggagaacgtcgtgcagggtcagatcaacatgcgggacgcagttcgccgcaccatcgaatacacgagccccgaggggaagcactacaagctgaatgacgaagttgcggtgctcatcgtgcgcccgcgcggctggcacctgcccgagaagcacatccgggtggacggccgggtggccacgggcgcgctcgtcgacttcgggctttacttctaccacaatgccaaggagcttttggcgcgcggcaccgggccctacttctacctgccgaagatggagagccacctcgaggcgaggctgtggaacgacgtgttcaactacgcccaggacgcgctcggcatcccgcgcggcaccatcaaggccactgtgctcatcgagaccatcctcgcgacgttcgagatggacgagatcctgtatgagctgcgcgatcacgccgcggggctcaactgcggccgctgggactacatcttcagctacatcaagaagttccgcaatcacccggaggtcatcctgcctgaccgggcgcaggtgacgatgacggtgccgttcatgcgcgcgtacaccctgctcaccatccgcacgtgccatcggcgcaaggcgttcgcgatgggcggcatggcggcgcagatccccatcaagaacgacccgaaggcgaacgaggaggcgctcgccaaggtgcgcgcggacaaggagcgcgaggcgcaggacggccacgacggcacctgggtggcgcacccgggtctcgtgcccgtggcgatggaggtgttcaatcgcctcatgcccacgcccaaccagttgcaccgcctgcgcgaggacgtccaggtcaccgcggccgatctcgtcgcggtcccgcagggcaccatcaccgaaggcggcctgcgcaccaacgtcgccgtggcgcttcgctacatcgaggcttggctgcgcggttccggcgcggtgcccatcttcaacctgatggaagacgcggcgacggcggagatctcccgcgcgcagatctggcagtggatccatcacccgaaaggcgtcctcgacgacggccgcaaggtgacggtggagctgttccggcagattctcgaagaggagttgcgcaagttgaaggacgagatcggcgaggaggcgtacgcacagagcaagttcccgctcgcggccgaacttctcgacgacatctcgacgaaggacgacttcgtcgacttcctgacgctgccgggttacgagcacctggcgtga

SEQ ID NO: 678 - DNA, 1605 bp, Artificial
  Substituion in SEQ ID NO 665
atggcgggatcgtacgcttgcccacagggcgtgcaaatcacgggcgaatacaggcctgagttcgccgaaatcctcacgacggacgcgcttcaattcatcgcggatcttgagcgccgcttcggtccgaggcgggacgaactgcttcgcctgcgcaaggagcgggacgagcggttgctcgcgggcgaatggccggacttcttgccggagaccaaggagattcgcgagagcgagtggacggtcgggcccatccccgcggatctgcaggatcggcgcgtggaaatcacgggcccgagttcggaccggaagatggtcatcaacgccttgaactcgggcgccaagtgcttcatggcggactttgaggacgcctgcgcaccgtcctgggagaacgtcgtgcagggtcagatcaacatgcgggacgcagttcgccgcaccatcgaatacacgagccccgaggggaagcactacaagctgaatgacgaagttgcggtgctcatcgtgcgcccgcgcggctggcacctgcccgagaagcacatccgggtggacggccgggtggccacgggcgcgctcgtcgacttcgggctttacttctaccacaatgccaaggagcttttggcgcgcggcaccgggccctacttctacctgccgaagatggagagccacctcgaggcgaggctgtggaacgacgtgttcaactacgcccaggacgcgctcggcatcccgcgcggcaccatcaaggccactgtgctcatcgagaccatcctcgcgacgttcgagatggacgagatcctgtatgagctgcgcgatcacgccgcggggctcaactgcggccgctgggactacatcttcagctacatcaagaagttccgcaatcacccggaggtcatcctgcctgaccgggcgcaggtgacgatgacggtgccgttcatgcgcgcgtacaccctgctcaccatccgcacgtgccatcggcgcaaggcgttcgcgatgggcggcatggcggcgcagatccccatcaagaacgacccgaaggcgaacgaggaggcgctcgccaaggtgcgcgcggacaaggagcgcgaggcgcaggacggccacgacggcacctgggtggcgcacccgggtctcgtgcccgtggcgatggaggtgttcaatcgcctcatgcccacgcccaaccagttgcaccgcctgcgcgaggacgtccaggtcaccgcggccgatctcgtcgcggtcccgcagggcaccatcaccgaaggcggcctgcgcaccaacgtcgccgtggcgcttcgctacatcgaggcttggctgcgcggttccggcgcggtgcccatcttcaacctgatggaagacgcggcgacggcggagatctcccgcgcgcagatctggcagtggatccatcacccgaaaggcgtcctcgacgacggccgcaaggtgacggtggagctgttccggcagattctcgaagaggagttgcgcaagttgaaggacgagatcggcgaggaggcgtacgcacagagcaagttcccgctcgcggccgaacttctcgacgacatctcgacgaaggacgacttcgtcgacttcctgacgctgccgggttacgagcacctggcgtga

SEQ ID NO: 679 - DNA, 1605 bp, Artificial
  Substituion in SEQ ID NO 665
atggcgggatcgtacgcttgcccacagggcgtgcaaatcacgggcgaatacaggcctgagttcgccgaaatcctcacgacggacgcgcttcaattcatcgcggagcttgagcgccgcttcggtccgaggcgggacgaactgcttcgcctgcgcaaggagcgggacgagcggttgctcgcgggcgaatggccggacttcttgccggagacccgtgagattcgcgagagcgagtggacggtcgggcccatccccgcggatctgcaggatcggcgcgtggaaatcacgggcccgagttcggaccggaagatggtcatcaacgccttgaactcgggcgccaagtgcttcatggcggactttgaggacgcctgcgcaccgtcctgggagaacgtcgtgcagggtcagatcaacatgcgggacgcagttcgccgcaccatcgaatacacgagccccgaggggaagcactacaagctgaatgacgaagttgcggtgctcatcgtgcgcccgcgcggctggcacctgcccgagaagcacatccgggtggacggccgggtggccacgggcgcgctcgtcgacttcgggctttacttctaccacaatgccaaggagcttttggcgcgcggcaccgggccctacttctacctgccgaagatggagagccacctcgaggcgaggctgtggaacgacgtgttcaactacgcccaggacgcgctcggcatcccgcgcggcaccatcaaggccactgtgctcatcgagaccatcctcgcgacgttcgagatggacgagatcctgtatgagctgcgcgatcacgccgcggggctcaactgcggccgctgggactacatcttcagctacatcaagaagttccgcaatcacccggaggtcatcctgcctgaccgggcgcaggtgacgatgacggtgccgttcatgcgcgcgtacaccctgctcaccatccgcacgtgccatcggcgcaaggcgttcgcgatgggcggcatggcggcgcagatccccatcaagaacgacccgaaggcgaacgaggaggcgctcgccaaggtgcgcgcggacaaggagcgcgaggcgcaggacggccacgacggcacctgggtggcgcacccgggtctcgtgcccgtggcgatggaggtgttcaatcgcctcatgcccacgcccaaccagttgcaccgcctgcgcgaggacgtccaggtcaccgcggccgatctcgtcgcggtcccgcagggcaccatcaccgaaggcggcctgcgcaccaacgtcgccgtggcgcttcgctacatcgaggcttggctgcgcggttccggcgcggtgcccatcttcaacctgatggaagacgcggcgacggcggagatctcccgcgcgcagatctggcagtggatccatcacccgaaaggcgtcctcgacgacggccgcaaggtgacggtggagctgttccggcagattctcgaagaggagttgcgcaagttgaaggacgagatcggcgaggaggcgtacgcacagagcaagttcccgctcgcggccgaacttctcgacgacatctcgacgaaggacgacttcgtcgacttcctgacgctgccgggttacgagcacctggcgtga

SEQ ID NO: 680 - DNA, 1605 bp, Artificial
  Substituion in SEQ ID NO 665
atggcgggatcgtacgcttgcccacagggcgtgcaaatcacgggcgaatacaggcctgagttcgccgaaatcctcacgacggacgcgcttcaattcatcgcggagcttgagcgccgcttcggtccgaggcgggacgaactgcttcgcctgcgcaaggagcgggacgagcggttgattgcgggcgaatggccggacttcttgccggagaccaaggagattcgcgagagcgagtggacggtcgggcccatccccgcggatctgcaggatcggcgcgtggaaatcacgggcccgagttcggaccggaagatggtcatcaacgccttgaactcgggcgccaagtgcttcatggcggactttgaggacgcctgcgcaccgtcctgggagaacgtcgtgcagggtcagatcaacatgcgggacgcagttcgccgcaccatcgaatacacgagccccgaggggaagcactacaagctgaatgacgaagttgcggtgctcatcgtgcgcccgcgcggctggcacctgcccgagaagcacatccgggtggacggccgggtggccacgggcgcgctcgtcgacttcgggctttacttctaccacaatgccaaggagcttttggcgcgcggcaccgggccctacttctacctgccgaagatggagagccacctcgaggcgaggctgtggaacgacgtgttcaactacgcccaggacgcgctcggcatcccgcgcggcaccatcaaggccactgtgctcatcgagaccatcctcgcgacgttcgagatggacgagatcctgtatgagctgcgcgatcacgccgcggggctcaactgcggccgctgggactacatcttcagctacatcaagaagttccgcaatcacccggaggtcatcctgcctgaccgggcgcaggtgacgatgacggtgccgttcatgcgcgcgtacaccctgctcaccatccgcacgtgccatcggcgcaaggcgttcgcgatgggcggcatggcggcgcagatccccatcaagaacgacccgaaggcgaacgaggaggcgctcgccaaggtgcgcgcggacaaggagcgcgaggcgcaggacggccacgacggcacctgggtggcgcacccgggtctcgtgcccgtggcgatggaggtgttcaatcgcctcatgcccacgcccaaccagttgcaccgcctgcgcgaggacgtccaggtcaccgcggccgatctcgtcgcggtcccgcagggcaccatcaccgaaggcggcctgcgcaccaacgtcgccgtggcgcttcgctacatcgaggcttggctgcgcggttccggcgcggtgcccatcttcaacctgatggaagacgcggcgacggcggagatctcccgcgcgcagatctggcagtggatccatcacccgaaaggcgtcctcgacgacggccgcaaggtgacggtggagctgttccggcagattctcgaagaggagttgcgcaagttgaaggacgagatcggcgaggaggcgtacgcacagagcaagttcccgctcgcggccgaacttctcgacgacatctcgacgaaggacgacttcgtcgacttcctgacgctgccgggttacgagcacctggcgtga

SEQ ID NO: 681 - protein, 489 aa, Alicyclobacillus acidocaldarius
MYPFSSYMTFTRRVSPWDRRHARRRATEMEARMMTIPWETLKEELGDKLSFGESVRRSHAKDESYHPEHLPDAVAYPEETADVVALARFSHAHGVPLVAYGAGSGLEGQVIPVRGGISVDFSRMNRVLEIRPDDFLVCVEPGVTRQQLNDALRPYGLMFPVDPGANASLGGMAATNASGTTAVRYGPMKANVRKLEVVLADGRVIEVGTLAAKSSSGYNLVELFVGSEGTLGLFTKLWLRVYGVPEATLAASAEFATVREAVDAVCMLIGSGLQLTRCELVTKPYIEIINRQFDTSYTPAPTLFLELSGSQAAVQADMGTVDEILRDAGAARVSVVMDERERQKLWHARHNAAYALMRTYPGLSHLSTDVCVPMSKLPEAVDVAETWIERLGIRGGIVGHVGDGNFHVSLMVNPSDPDDLGRAYELSHHLVEYALSVGGTCTGEHGVGLGKMKYQKQEHGEALALMQAVKRLFDPADMLNPGKLVDGIA

SEQ ID NO: 682 - DNA, 1470 bp, Alicyclobacillus acidocaldarius
atgtatcccttttcatcctatatgacctttacgcggcgcgtaagcccctgggacaggcgccatgcgcgcaggcgtgcgacagaaatggaggcccggatgatgaccatcccttgggagacgttgaaagaggagctcggcgacaagctcagcttcggcgagagcgttcgccgatcgcacgcgaaggacgaatcgtatcacccggagcacctgccggacgccgtggcctatccggaggagacggcggatgtcgtggcacttgcgcggttttcgcatgcgcacggggtgccgctcgtcgcttacggcgccggatcgggcctcgagggccaggtcatccccgtgcgcggcggcatctcggtcgacttttcgcggatgaaccgcgtgctcgagatccggccggacgacttcctcgtctgcgtcgagcccggcgtcacgcgccagcagttgaacgacgccctgcgcccgtacggcctcatgtttccggtcgatcccggcgccaacgcgtccttgggcggcatggcggcgacgaacgcgagcggcacgacggcggtgcggtatggcccgatgaaggcgaacgtgcggaagctcgaggtggtgctcgcggatgggcgcgtgatcgaggtgggaacgctcgccgccaaatccagctccggctataatctcgtcgaactcttcgtgggctcggaaggcacgctaggcttgttcacgaagctctggctccgcgtctacggtgtgcccgaggcgacgctcgccgcctccgcggagtttgcgacggtccgcgaggcggtggacgccgtgtgcatgctcatcggcagcgggctccagctcacgcgttgcgaacttgtgacaaagccgtacatcgagatcatcaaccgccagtttgacacgtcctacacgcccgcgccgaccctgttcctcgagctgtcgggctctcaggccgcggtgcaggccgacatggggacggtcgacgagatcctgcgcgacgccggcgcagcccgcgtctccgtcgtcatggatgagcgcgaacgccagaagctttggcacgcgcggcacaacgcggcgtatgcgctcatgcggacctacccagggctgtcgcacctctcgacggacgtgtgcgtgcccatgtcgaagctgcccgaggcagtcgacgtggcggagacgtggatcgagcggctcgggatccgcgggggcatcgtggggcacgtcggcgacggcaacttccacgtcagcctgatggtcaacccgagcgacccggacgatctcggccgcgcctacgagctctcgcaccacctggtcgagtacgcgctgtccgtcggcggcacgtgcacgggcgagcacggcgtcgggctcggcaagatgaagtatcagaagcaggagcacggcgaggcgctcgccctgatgcaggcggtgaagcggctgttcgatccggccgacatgctcaaccccgggaagctggtcgacgggatcgcgtga

SEQ ID NO: 683 - protein, 440 aa, Bacillus sp. B14905
LEEQVSTNETVRQLHGKDESHHPMSLPDIVVFPRSTADVSAILKVAHAQRVPVVPFGVGSSLEGNAIPIANGISIDFSEMNAILEVRPEDLLVKVQPGVTRSQLNKELKKHGLQFTVDPGADATLGGMAATNASGTTAVRYGVMRDQVRDLEVVLADGSVIHTGNLAAKSSSGYHLNGLFVGSEGTLGCFTELTLKVYGIPEFVTAGRAVFNTVGDAVSSVTALLQTGISVGRVELVDEASIQQANIYNDTAFSEKPTLFLEFHGNEAGMHADIAFATEIFEDFHCLSVEFEHDNAGRNKLWEARHSLAYAYMHAHPGKKLMSTDVCVPISMLAETILYAREQLNTVGLAGGIVGHVGDGNFHALLMLNPDDAEEQAKADRFNEHIVQYALLRGGTCTGEHGVGIGKMRYQATEHGSSLAVMKSIKIALDPLNIMNPGKI

SEQ ID NO: 684 - protein, 439 aa, Bacillus cereus G9241
GDRVVVNTTVRELHSKDESYHASSLPDVVVFPKTTEEVSSIMKVASQHGTAIVPFGVGSSLEGHVIPYEKGITVDFSLMNKILEIREKDFLVRVQPGVTRSQLNKELKKYGLFFSVDPGADATLGGMAATNASGTTAVKYGVMRDQVRDLEVVLADGEVIHTGNLAAKSSSGYHLNGIFVGSEGTLGCFTELTLKVYGIPEHVMAARASFPAINDAVEAVINILQAGIPIARIELVDELSMKQVNHYSETSYREEPTLFLEFHGNEAGLKQDIEFTKEIVFDHKCKEVAFETETAARNKLWDARHNLAYAYVHSYPGKKLMSTDVCVPISELAGAIQHAKETLDKVGLVGGILGHVGDGNFHVLLMVDPNDKEEVEKADEINESIVLYALKRGGTCTGEHGVGIGKRKYQEEEHGAALFVMEKIKRALDPQNILNPNKV

SEQ ID NO: 685 - protein, 438 aa, Bacillus thuringiensis str. Al Hakam
DRVVINTTVRELHSKDESYHASSLPDVVVFPKTTEEVSTIMKIASEHGTPVVPFGVGSSLEGHVIPYEKGITVDFSLMNKILEIREKDFLVKVQPGVTRSQLNKELKKYGLFFSVDPGADATLGGMAATNASGTTAVKYGVMRDQVRDLEVVLADGEVIHTGNLAAKSSSGYHLNGVFVGSEGTLGCFTELTLKVYGIPEHVMAARASFPAINDAVEAVINILQAGIPIARIELVDELSMKQVNHYSETSYREEPTLFLEFHGNEAGLKQDVEFTKEIVFDQKCKEVAFETETAARNKLWDARHNLAYAYVHSYPGKKLMSTDVCVPISELAGAIQQAKETLEKNGLVGGILGHVGDGNFHVLLMVDPNDKEEVEKADEINESIVLYALKRGGTCTGEHGVGIGKRKYQEEEHGAALFVMEKIKKALDPQNILNPNKV

SEQ ID NO: 686 - protein, 438 aa, Bacillus thuringiensis serovar konkukian str. 97-27
DRVVINTTVRELHSKDESYHASSLPDVVVFPKTTEEVSTIMKVASEHGTPVVPFGVGSSLEGHVIPYEKGITVDFSLMNKILEIREKDFLVRVQPGVTRSQLNKELKKYGLFFSVDPGADATLGGMAATNASGTTAVKYGVMRDQVRDLEVVLADGEVIHTGNLAAKSSSGYHLNGVFVGSEGTLGCFTELTLKVYGIPEHVMAARASFPTINDAVEAVINILQAGIPIARIELVDELSMKQVNHYSETSYREEPTLFLEFHGNEAGLKQDVEFTKEIVFDHKCKEVAFETETAARNKLWDARHNLAYAYVHSYPGKKLMSTDVCVPISELAGAIQQAKETLEKNGLVGGILGHVGDGNFHVLLMVDPNDKEEVEKADKINESIVLYALKRGGTCTGEHGVGIGKRKYQEEEHGAALLVMEKIKKALDPQNILNPNKV

SEQ ID NO: 687 - protein, 438 aa, Bacillus weihenstephanensis KBAB4
DQVVVNKTVRELHSKDESYHNSSLPDVVVFPKTTEEVRAIMKVASEHKKPVIPFGVGSSLEGHIIPYEKGITVDFSLMNKILEIREKDFLVKVQPGVTRSQLNKELKKYGLFFSVDPGADATLGGMAATNASGTTAVRYGVMRDQVRDLEVVLADGQVIHTGNLAAKSSSGYHLNGIFVGSEGTLGCFTELTLKVYGIPEHVMAARASFPTINDAVEAVINILQAGIPIARIELVDELSMKQVNHYNETNYREEPTLFLEFHGNEAGLTQDIEFTKEIVFDHKCKEVAFETETVARNKLWDARHNLAYSYVHSYPGKKLMSTDVCVPISELAGAIQHAKETLDKVGLVGGILGHVGDGNFHVLLMINPNDKDEVKKADEINESIVLYALKRGGTCTGEHGVGIGKQKYQEEEHGAALLVMEKIKKALDPQNILNPNKI

SEQ ID NO: 688 - protein, 489 aa, Artificial
  Substituion in SEQ ID NO 681
MYPFSSYMTFTRRVSPWDRRHARRRATEMEARMMTIPWETLKEELGDKLSFGESVRRSHAKDESYHPEHLPDAVAYPEETADVVALARFSHAHGVPLVAYGAGSGLEGQVIPVRGGISVDFSRMNRVLEIRPDDFLVCVEPGVTRQQLNDALRPYGLMFPVDPGANASLGGMAATNASGTTAVRYGPMKANVRKLEVVLADGKVIEVGTLAAKSSSGYNLVELFVGSEGTLGLFTKLWLRVYGVPEATLAASAEFATVREAVDAVCMLIGSGLQLTRCELVTKPYIEIINRQFDTSYTPAPTLFLELSGSQAAVQADMGTVDEILRDAGAARVSVVMDERERQKLWHARHNAAYALMRTYPGLSHLSTDVCVPMSKLPEAVDVAETWIERLGIRGGIVGHVGDGNFHVSLMVNPSDPDDLGRAYELSHHLVEYALSVGGTCTGEHGVGLGKMKYQKQEHGEALALMQAVKRLFDPADMLNPGKLVDGIA

SEQ ID NO: 689 - protein, 489 aa, Artificial
  Substituion in SEQ ID NO 681
MYPFSSYMTFTRRVSPWDRRHARRRATEMEARMMTIPWETLKEELGDKLSFGESVRRSHAKDESYHPEHLPDAVAYPEETADVVALARFSHAHGVPLVAYGAGSGLEGQVIPVRGGISVDFSRMNRVLEIRPDDFLVCVEPGVTRQQLNDALRPYGLMFPVDPGANASLGGMAATNASGTTAVRYGPMKANVRKLEVVLADGRVIEVGTLAAKSSSGYNLVELFVGSEGTLGLFTKLWLRVYGVPEATLAASAEFATVREAVDAVCMLIGSGLQLTRCELVTKPYIEIINRQFDTSYTPAPTLFLELSGSQAAVQADMGTVDEILRDAGAARVSVVMDDRERQKLWHARHNAAYALMRTYPGLSHLSTDVCVPMSKLPEAVDVAETWIERLGIRGGIVGHVGDGNFHVSLMVNPSDPDDLGRAYELSHHLVEYALSVGGTCTGEHGVGLGKMKYQKQEHGEALALMQAVKRLFDPADMLNPGKLVDGIA

SEQ ID NO: 690 - protein, 489 aa, Artificial
  Substituion in SEQ ID NO 681
MYPFSSYMTFTRRVSPWDRRHARRRATEMEARMMTIPWETLKEELGDKLSFGESVRRSHAKDESYHPEHLPDAVAYPEETADVVALARFSHAHGVPLVAYGAGSGLEGQVIPVRGGISVDFSRMNRVLEIRPDDFLVCVEPGVTRQQLNDALRPYGLMFPVDPGANASLGGMAATNASGTTAVRYGPMKANVRKLEVVLADGRVIEVGTLAAKSSSGYNLVELFVGSEGTLGLFTKLWLRVYGVPEATLAASAEFATVREAVDAVCMLIGSGLQLTRCELVTKPYIEIINRQFDTSYTPAPTLFLELSGSQAAVQADMGTVDEILRDAGAARVSVVMDERERQKLWHARHNAAYALMRTYPGLSHLSTDVCVPMSKLPEAVDIAETWIERLGIRGGIVGHVGDGNFHVSLMVNPSDPDDLGRAYELSHHLVEYALSVGGTCTGEHGVGLGKMKYQKQEHGEALALMQAVKRLFDPADMLNPGKLVDGIA

SEQ ID NO: 691 - protein, 489 aa, Artificial
  Substituion in SEQ ID NO 681
MYPFSSYMTFTRRVSPWDRRHAKRRATEMEARMMTIPWETLKEELGDKLSFGESVRRSHAKDESYHPEHLPDAVAYPEETADVVALARFSHAHGVPLVAYGAGSGLEGQVIPVRGGISVDFSRMNRVLEIRPDDFLVCVEPGVTRQQLNDALRPYGLMFPVDPGANASLGGMAATNASGTTAVRYGPMKANVRKLEVVLADGRVIEVGTLAAKSSSGYNLVELFVGSEGTLGLFTKLWLRVYGVPEATLAASAEFATVREAVDAVCMLIGSGLQLTRCELVTKPYIEIINRQFDTSYTPAPTLFLELSGSQAAVQADMGTVDEILRDAGAARVSVVMDERERQKLWHARHNAAYALMRTYPGLSHLSTDVCVPMSKLPEAVDVAETWIERLGIRGGIVGHVGDGNFHVSLMVNPSDPDDLGRAYELSHHLVEYALSVGGTCTGEHGVGLGKMKYQKQEHGEALALMQAVKRLFDPADMLNPGKLVDGIA

SEQ ID NO: 692 - protein, 489 aa, Artificial
  Substituion in SEQ ID NO 681
MYPFSSYMTFTRRVSPWDRRHARRRATEMEARMMTIPWETLKEELGDKLSFGESVRRSHAKDESYHPEHLPDAVAYPEETADVVALARFSHAHGVPLVAYGAGSGLEGQVIPVRGGISVDFSRMNRVLEIRPDDFLVCVEPGVTRQQLNDALRPYGLMFPVDPGANASLGGMAATNASGTTAVRYGPMKANVRKLEVVLADGRVIEVGTLAAKSSSGYNLVELFVGSEGTLGIFTKLWLRVYGVPEATLAASAEFATVREAVDAVCMLIGSGLQLTRCELVTKPYIEIINRQFDTSYTPAPTLFLELSGSQAAVQADMGTVDEILRDAGAARVSVVMDERERQKLWHARHNAAYALMRTYPGLSHLSTDVCVPMSKLPEAVDVAETWIERLGIRGGIVGHVGDGNFHVSLMVNPSDPDDLGRAYELSHHLVEYALSVGGTCTGEHGVGLGKMKYQKQEHGEALALMQAVKRLFDPADMLNPGKLVDGIA

SEQ ID NO: 693 - DNA, 1470 bp, Artificial
  Substituion in SEQ ID NO 682
atgtatcccttttcatcctatatgacctttacgcggcgcgtaagcccctgggacaggcgccatgcgcgcaggcgtgcgacagaaatggaggcccggatgatgaccatcccttgggagacgttgaaagaggagctcggcgacaagctcagcttcggcgagagcgttcgccgatcgcacgcgaaggacgaatcgtatcacccggagcacctgccggacgccgtggcctatccggaggagacggcggatgtcgtggcacttgcgcggttttcgcatgcgcacggggtgccgctcgtcgcttacggcgccggatcgggcctcgagggccaggtcatccccgtgcgcggcggcatctcggtcgacttttcgcggatgaaccgcgtgctcgagatccggccggacgacttcctcgtctgcgtcgagcccggcgtcacgcgccagcagttgaacgacgccctgcgcccgtacggcctcatgtttccggtcgatcccggcgccaacgcgtccttgggcggcatggcggcgacgaacgcgagcggcacgacggcggtgcggtatggcccgatgaaggcgaacgtgcggaagctcgaggtggtgctcgcggatgggaaagtgatcgaggtgggaacgctcgccgccaaatccagctccggctataatctcgtcgaactcttcgtgggctcggaaggcacgctaggcttgttcacgaagctctggctccgcgtctacggtgtgcccgaggcgacgctcgccgcctccgcggagtttgcgacggtccgcgaggcggtggacgccgtgtgcatgctcatcggcagcgggctccagctcacgcgttgcgaacttgtgacaaagccgtacatcgagatcatcaaccgccagtttgacacgtcctacacgcccgcgccgaccctgttcctcgagctgtcgggctctcaggccgcggtgcaggccgacatggggacggtcgacgagatcctgcgcgacgccggcgcagcccgcgtctccgtcgtcatggatgagcgcgaacgccagaagctttggcacgcgcggcacaacgcggcgtatgcgctcatgcggacctacccagggctgtcgcacctctcgacggacgtgtgcgtgcccatgtcgaagctgcccgaggcagtcgacgtggcggagacgtggatcgagcggctcgggatccgcgggggcatcgtggggcacgtcggcgacggcaacttccacgtcagcctgatggtcaacccgagcgacccggacgatctcggccgcgcctacgagctctcgcaccacctggtcgagtacgcgctgtccgtcggcggcacgtgcacgggcgagcacggcgtcgggctcggcaagatgaagtatcagaagcaggagcacggcgaggcgctcgccctgatgcaggcggtgaagcggctgttcgatccggccgacatgctcaaccccgggaagctggtcgacgggatcgcgtga

SEQ ID NO: 694 - DNA, 1470 bp, Artificial
  Substituion in SEQ ID NO 682
atgtatcccttttcatcctatatgacctttacgcggcgcgtaagcccctgggacaggcgccatgcgcgcaggcgtgcgacagaaatggaggcccggatgatgaccatcccttgggagacgttgaaagaggagctcggcgacaagctcagcttcggcgagagcgttcgccgatcgcacgcgaaggacgaatcgtatcacccggagcacctgccggacgccgtggcctatccggaggagacggcggatgtcgtggcacttgcgcggttttcgcatgcgcacggggtgccgctcgtcgcttacggcgccggatcgggcctcgagggccaggtcatccccgtgcgcggcggcatctcggtcgacttttcgcggatgaaccgcgtgctcgagatccggccggacgacttcctcgtctgcgtcgagcccggcgtcacgcgccagcagttgaacgacgccctgcgcccgtacggcctcatgtttccggtcgatcccggcgccaacgcgtccttgggcggcatggcggcgacgaacgcgagcggcacgacggcggtgcggtatggcccgatgaaggcgaacgtgcggaagctcgaggtggtgctcgcggatgggcgcgtgatcgaggtgggaacgctcgccgccaaatccagctccggctataatctcgtcgaactcttcgtgggctcggaaggcacgctaggcttgttcacgaagctctggctccgcgtctacggtgtgcccgaggcgacgctcgccgcctccgcggagtttgcgacggtccgcgaggcggtggacgccgtgtgcatgctcatcggcagcgggctccagctcacgcgttgcgaacttgtgacaaagccgtacatcgagatcatcaaccgccagtttgacacgtcctacacgcccgcgccgaccctgttcctcgagctgtcgggctctcaggccgcggtgcaggccgacatggggacggtcgacgagatcctgcgcgacgccggcgcagcccgcgtctccgtcgtcatggatgatcgcgaacgccagaagctttggcacgcgcggcacaacgcggcgtatgcgctcatgcggacctacccagggctgtcgcacctctcgacggacgtgtgcgtgcccatgtcgaagctgcccgaggcagtcgacgtggcggagacgtggatcgagcggctcgggatccgcgggggcatcgtggggcacgtcggcgacggcaacttccacgtcagcctgatggtcaacccgagcgacccggacgatctcggccgcgcctacgagctctcgcaccacctggtcgagtacgcgctgtccgtcggcggcacgtgcacgggcgagcacggcgtcgggctcggcaagatgaagtatcagaagcaggagcacggcgaggcgctcgccctgatgcaggcggtgaagcggctgttcgatccggccgacatgctcaaccccgggaagctggtcgacgggatcgcgtga

SEQ ID NO: 695 - DNA, 1470 bp, Artificial
  Substituion in SEQ ID NO 682
atgtatcccttttcatcctatatgacctttacgcggcgcgtaagcccctgggacaggcgccatgcgcgcaggcgtgcgacagaaatggaggcccggatgatgaccatcccttgggagacgttgaaagaggagctcggcgacaagctcagcttcggcgagagcgttcgccgatcgcacgcgaaggacgaatcgtatcacccggagcacctgccggacgccgtggcctatccggaggagacggcggatgtcgtggcacttgcgcggttttcgcatgcgcacggggtgccgctcgtcgcttacggcgccggatcgggcctcgagggccaggtcatccccgtgcgcggcggcatctcggtcgacttttcgcggatgaaccgcgtgctcgagatccggccggacgacttcctcgtctgcgtcgagcccggcgtcacgcgccagcagttgaacgacgccctgcgcccgtacggcctcatgtttccggtcgatcccggcgccaacgcgtccttgggcggcatggcggcgacgaacgcgagcggcacgacggcggtgcggtatggcccgatgaaggcgaacgtgcggaagctcgaggtggtgctcgcggatgggcgcgtgatcgaggtgggaacgctcgccgccaaatccagctccggctataatctcgtcgaactcttcgtgggctcggaaggcacgctaggcttgttcacgaagctctggctccgcgtctacggtgtgcccgaggcgacgctcgccgcctccgcggagtttgcgacggtccgcgaggcggtggacgccgtgtgcatgctcatcggcagcgggctccagctcacgcgttgcgaacttgtgacaaagccgtacatcgagatcatcaaccgccagtttgacacgtcctacacgcccgcgccgaccctgttcctcgagctgtcgggctctcaggccgcggtgcaggccgacatggggacggtcgacgagatcctgcgcgacgccggcgcagcccgcgtctccgtcgtcatggatgagcgcgaacgccagaagctttggcacgcgcggcacaacgcggcgtatgcgctcatgcggacctacccagggctgtcgcacctctcgacggacgtgtgcgtgcccatgtcgaagctgcccgaggcagtcgacattgcggagacgtggatcgagcggctcgggatccgcgggggcatcgtggggcacgtcggcgacggcaacttccacgtcagcctgatggtcaacccgagcgacccggacgatctcggccgcgcctacgagctctcgcaccacctggtcgagtacgcgctgtccgtcggcggcacgtgcacgggcgagcacggcgtcgggctcggcaagatgaagtatcagaagcaggagcacggcgaggcgctcgccctgatgcaggcggtgaagcggctgttcgatccggccgacatgctcaaccccgggaagctggtcgacgggatcgcgtga

SEQ ID NO: 696 - DNA, 1470 bp, Artificial
  Substituion in SEQ ID NO 682
atgtatcccttttcatcctatatgacctttacgcggcgcgtaagcccctgggacaggcgccatgcgaaaaggcgtgcgacagaaatggaggcccggatgatgaccatcccttgggagacgttgaaagaggagctcggcgacaagctcagcttcggcgagagcgttcgccgatcgcacgcgaaggacgaatcgtatcacccggagcacctgccggacgccgtggcctatccggaggagacggcggatgtcgtggcacttgcgcggttttcgcatgcgcacggggtgccgctcgtcgcttacggcgccggatcgggcctcgagggccaggtcatccccgtgcgcggcggcatctcggtcgacttttcgcggatgaaccgcgtgctcgagatccggccggacgacttcctcgtctgcgtcgagcccggcgtcacgcgccagcagttgaacgacgccctgcgcccgtacggcctcatgtttccggtcgatcccggcgccaacgcgtccttgggcggcatggcggcgacgaacgcgagcggcacgacggcggtgcggtatggcccgatgaaggcgaacgtgcggaagctcgaggtggtgctcgcggatgggcgcgtgatcgaggtgggaacgctcgccgccaaatccagctccggctataatctcgtcgaactcttcgtgggctcggaaggcacgctaggcttgttcacgaagctctggctccgcgtctacggtgtgcccgaggcgacgctcgccgcctccgcggagtttgcgacggtccgcgaggcggtggacgccgtgtgcatgctcatcggcagcgggctccagctcacgcgttgcgaacttgtgacaaagccgtacatcgagatcatcaaccgccagtttgacacgtcctacacgcccgcgccgaccctgttcctcgagctgtcgggctctcaggccgcggtgcaggccgacatggggacggtcgacgagatcctgcgcgacgccggcgcagcccgcgtctccgtcgtcatggatgagcgcgaacgccagaagctttggcacgcgcggcacaacgcggcgtatgcgctcatgcggacctacccagggctgtcgcacctctcgacggacgtgtgcgtgcccatgtcgaagctgcccgaggcagtcgacgtggcggagacgtggatcgagcggctcgggatccgcgggggcatcgtggggcacgtcggcgacggcaacttccacgtcagcctgatggtcaacccgagcgacccggacgatctcggccgcgcctacgagctctcgcaccacctggtcgagtacgcgctgtccgtcggcggcacgtgcacgggcgagcacggcgtcgggctcggcaagatgaagtatcagaagcaggagcacggcgaggcgctcgccctgatgcaggcggtgaagcggctgttcgatccggccgacatgctcaaccccgggaagctggtcgacgggatcgcgtga

SEQ ID NO: 697 - DNA, 1470 bp, Artificial
  Substituion in SEQ ID NO 682
atgtatcccttttcatcctatatgacctttacgcggcgcgtaagcccctgggacaggcgccatgcgcgcaggcgtgcgacagaaatggaggcccggatgatgaccatcccttgggagacgttgaaagaggagctcggcgacaagctcagcttcggcgagagcgttcgccgatcgcacgcgaaggacgaatcgtatcacccggagcacctgccggacgccgtggcctatccggaggagacggcggatgtcgtggcacttgcgcggttttcgcatgcgcacggggtgccgctcgtcgcttacggcgccggatcgggcctcgagggccaggtcatccccgtgcgcggcggcatctcggtcgacttttcgcggatgaaccgcgtgctcgagatccggccggacgacttcctcgtctgcgtcgagcccggcgtcacgcgccagcagttgaacgacgccctgcgcccgtacggcctcatgtttccggtcgatcccggcgccaacgcgtccttgggcggcatggcggcgacgaacgcgagcggcacgacggcggtgcggtatggcccgatgaaggcgaacgtgcggaagctcgaggtggtgctcgcggatgggcgcgtgatcgaggtgggaacgctcgccgccaaatccagctccggctataatctcgtcgaactcttcgtgggctcggaaggcacgctaggcattttcacgaagctctggctccgcgtctacggtgtgcccgaggcgacgctcgccgcctccgcggagtttgcgacggtccgcgaggcggtggacgccgtgtgcatgctcatcggcagcgggctccagctcacgcgttgcgaacttgtgacaaagccgtacatcgagatcatcaaccgccagtttgacacgtcctacacgcccgcgccgaccctgttcctcgagctgtcgggctctcaggccgcggtgcaggccgacatggggacggtcgacgagatcctgcgcgacgccggcgcagcccgcgtctccgtcgtcatggatgagcgcgaacgccagaagctttggcacgcgcggcacaacgcggcgtatgcgctcatgcggacctacccagggctgtcgcacctctcgacggacgtgtgcgtgcccatgtcgaagctgcccgaggcagtcgacgtggcggagacgtggatcgagcggctcgggatccgcgggggcatcgtggggcacgtcggcgacggcaacttccacgtcagcctgatggtcaacccgagcgacccggacgatctcggccgcgcctacgagctctcgcaccacctggtcgagtacgcgctgtccgtcggcggcacgtgcacgggcgagcacggcgtcgggctcggcaagatgaagtatcagaagcaggagcacggcgaggcgctcgccctgatgcaggcggtgaagcggctgttcgatccggccgacatgctcaaccccgggaagctggtcgacgggatcgcgtga

SEQ ID NO: 698 - protein, 388 aa, Alicyclobacillus acidocaldarius
MMRTLDEWKKDVDAYVAGPARAWSEHIEATGTVPDALWRELRDAGYLRLAAPPHLGGHGLSFTDYLDLLRRFAHTHGSIRVMVHVANSLWRSLAQKATPEQVERFVKPFVAGDIRVTFTLTEPNSGSGADIKTTARREGDEYVLNGEKWMIIFSDVADYFLLFCRLEGTSGGEGTLALLVPRDAPGLTVELMAPAMGIAGTAHGHLRLRDCRVPVANRLGEEGDGLEVAFRGFLDPSRTAIGMTCVGAAERALELAADHALRRVTFGQPLAKRQIIQMWLAEMATDIEAARQLVLHAARRFDEGHPITVEAAMAKMFATEMLQRVTDKALQIHGGPGYFKSSEIERIYRDARMQRFEEGTSEIQKMVIARDVIDKAKRASEGSERRCW

SEQ ID NO: 699 - DNA, 1167 bp, Alicyclobacillus acidocaldarius
atgatgcggacgctggacgagtggaagaaggacgtcgacgcttacgtcgcgggcccggccagggcgtggtctgagcatattgaggcgacggggacggtgccggacgccctgtggcgagagcttcgcgacgccggctacctgcggctcgccgccccgccccatctcggcgggcacgggctcagcttcacggattacctggatctcttgcgccgattcgcgcacacgcacgggtccatccgcgtgatggtgcacgtggcgaacagcctatggcgctcgctcgcgcagaaggcgacgccggagcaggtggagcggtttgtgaagccgtttgtcgcgggcgacatccgcgtgacgttcacactgacggagccgaattcgggctccggcgcggacatcaagacgacggcccggcgcgagggcgacgagtacgtcctgaacggcgaaaagtggatgatcatcttcagcgacgtggcggactacttcctgctcttctgccggttggaggggacgtcgggcggcgaagggacgctcgcgctcctcgtcccgcgcgacgcgccgggcctcacggttgagctcatggcgccggccatgggcatcgcgggcacggcgcacgggcaccttcgcctgcgcgactgccgcgtacccgtcgccaaccgcctcggcgaggagggcgacggcctggaggtggcgttccgcggctttctggatccgtcccgcaccgccattggcatgacctgcgtcggcgcagcggagcgagcgctcgaactcgcggccgatcacgccctccggcgcgtcaccttcggccagccgctcgccaagcgccaaatcatccagatgtggctcgcggagatggcgacggacatcgaggcggcgcgccagctcgtcctccacgcggcccggcggttcgacgaaggccatcccatcaccgtggaggcggcgatggcgaagatgttcgcgacggagatgctgcagcgcgtgacggacaaggccctgcagattcacggcgggccgggttacttcaagtcgagcgagatcgagcggatctaccgggacgccaggatgcagcggttcgaggaaggcacgtcggagattcagaagatggtcattgcgcgcgacgtgatcgacaaggccaagcgggcctcagaagggagcgagcggagatgctggtga

SEQ ID NO: 700 - protein, 366 aa, Acidothermus cellulolyticus 11B
RREVEEFVRGPGERYAEQIEAENRVPESLWTELRDRGYLRLAAPQEYGGRGLQFSKYLELVELFAMSHASLRMIVHVVNGIWRAIDQLATDEQRKKFVLPQVAGDIRVAFTLTEPTAGTGADIRSTVVRDGDTYYLTGEKHLITFGVRCDYWLLFARVAGTTGKDGTVALMVDRHSPNVVVKEMSPSMGVRGTDHAHLIFRETPVPVANRLGAEGEGLDVAFGGFLTPSRISVAMTCVGLARRAQELAVEYAKQRVTFGKRLADRQVIAYALAENATDIEAARQLTLYAARQWESGAADALTLSSMAKLNAVDMLTRVTDKALQIHGGIGYFQSSPIERVYRDARAQRFEEGTNEIQKTVIARSVL

SEQ ID NO: 701 - protein, 375 aa, Streptomyces sp. HK803
VERWVEGPGERWAERIEETGEVPEAVWSELDELGFLRLAAPVEYGGQGLGFTQWMELMEIFSRSHGSLRMIVHVVNGIWRSMDGHACDEQRKRFVVPSVLGEIKIAFALTEPGNGTGADITTSVVREGDTYYLSGRKHLITFGMRCDYYLLAARVAGSAGHEGTVALLVPRNAPGVSAEDTSRTMGVTGTDHASIVFDRTPVPVDHRLGEEGQGLEVFLGGFLTPSRISVAMSCVGLAQRAQQLAVDYARSRVTFGKSLTERQAIQFMLAENAADIEAARQLVLHAARRFEEGADDASMQSSMAKMHAVTMLTTVTDKALQVHGGLGYWKSQKIERVYRDARAQRFEEGPNEVQKAVVFRELLRQAGTVTAGGAR

SEQ ID NO: 702 - protein, 346 aa, Rhodococcus sp. RHA1
QRIEDDEQVPHDIVMPILERIGALGLLVPREYGGSGLSIAQYLPIIAEFAKVQGALRVIVHVHNSFAHALSEIGSDRQKADVLPGTATGRNSVAFALTEPGFGTGADLGSTAVREGDGYILNGEKWLITNSDIASHFIVFAKTTATDVSAFLVPRETDGLSIAALPETMGCKGTEHGRVTLDSVRVPATALVGVEGQGNEHLERALEISRVFIAASSLGTSERALELSIAHAKSRVTFGKPIGTRQAIQRYLAEMATDVYALRGILADAAQKWDAGERIPAEASMCKLFGLEAVGRVTDRALLIHGGIGYTRAHPIERLYRDARLNWLEEGTPTIQYLVTAGRLLD

SEQ ID NO: 703 - protein, 345 aa, Mycobacterium smegmatis str. MC2 155
ERIENEERIPNEIVLPILERIGAFGLLVPREYGGSGLSIAQYLPIISEFAKVQGGLRVIVHVHNSFAHALSEIGNDEQKAAVLHGAATGANSVAFALTEPGHGTGADLGSSAVRMGDEYEITGEKWLITNSDIATHFIVFAKTAPTEVSAFLVPRDTDGLSIEPLPETMGCKGGEHGHIRLAGVRVPATALIGAEGEGNQHLERALEISRVFIAASSLGTSERALELSVARAKERVTFGKPIGSRQAIQRYLAEMATDIYALRGLLADAAHKWDSGKRIPAEASMCKLFGLEAVGRVTDRALLIHGGIGYTRAYPVERLYRDARLNWLEEGTPTIQYMVAANELL

SEQ ID NO: 704 - protein, 363 aa, Bacillus selenitireducens MLS10
VRQFAAERVAPFVEEMEMNETFPDALLREMGELGLLGIPVEEEHGGAGMDFTSYIIAIHELSKVSATLGVILSVHTSVGTNPIRYYGTADQISRYVPKLASGEWLGAFALSEPGAGSDAASLRTTAKKDGDHYILNGSKAWITNGGYADTYIVFAKTDPDAGKKGITAFIVEKDTPGFTVLAKERKMGLLGSSTTGLAFEDCRIHESRRLGEEGQGYTIALSNLDYGRVGIAAQALGIAEAALEHATDYAKERKQFGKPIAMQQGLAFKLADMATAVEAAKLLTYSAANRKDQGLTTGIEASMAKTFASDTAMKVTTEAIQVFGGYGYTKDYPVERFFRDAKVTQIYEGTNEIQRIVIAGQLL

SEQ ID NO: 705 - protein, 388 aa, Artificial
  Substituion in SEQ ID NO 698
MMRTLDEWKKDVDAYVAGPARAWSEHIEATGTVPDALWRELRDAGYLRLAAPPHLGGHGLSFTDYLDLLRRFAHTHGSIRVMVHVANSLWRSLAQKATPEQVERFVKPFVAGDIRVTFTLTEPNSGSGADIKTTARREGDEYVLNGEKWMIIFSDVADYFLLFCRLEGTSGGEGTIALLVPRDAPGLTVELMAPAMGIAGTAHGHLRLRDCRVPVANRLGEEGDGLEVAFRGFLDPSRTAIGMTCVGAAERALELAADHALRRVTFGQPLAKRQIIQMWLAEMATDIEAARQLVLHAARRFDEGHPITVEAAMAKMFATEMLQRVTDKALQIHGGPGYFKSSEIERIYRDARMQRFEEGTSEIQKMVIARDVIDKAKRASEGSERRCW

SEQ ID NO: 706 - protein, 388 aa, Artificial
  Substituion in SEQ ID NO 698
MMRTLDEWKKDVDAYVAGPARAWSEHIEATGTVPDALWRELRDAGYLRLAAPPHLGGHGLSFTDYLDLLRRFAHTHGSIRVMVHVANSLWRSLAQKATPEQVERFVKPFVAGDIRVTFTLTEPNSGSGADIKTTARREGDEYVLNGEKWMIIFSDVADYFLLFCRIEGTSGGEGTLALLVPRDAPGLTVELMAPAMGIAGTAHGHLRLRDCRVPVANRLGEEGDGLEVAFRGFLDPSRTAIGMTCVGAAERALELAADHALRRVTFGQPLAKRQIIQMWLAEMATDIEAARQLVLHAARRFDEGHPITVEAAMAKMFATEMLQRVTDKALQIHGGPGYFKSSEIERIYRDARMQRFEEGTSEIQKMVIARDVIDKAKRASEGSERRCW

SEQ ID NO: 707 - protein, 388 aa, Artificial
  Substituion in SEQ ID NO 698
MMRTLDEWKKDVDAYVAGPARAWSEHIEATGTVPDALWRELRDAGYLRLAAPPHLGGHGLSFTDYLDLLRRFAHTHGSIRVMVHVANSLWRSLAQKATPEQVERFVKPFVAGDIRVTFTLTEPNSGSGADIKTTARREGDEYVLNGEKWMIIFSDVADYFLLFCRLEGTSGGEGTLALLVPRDAPGLTVELMAPAMGIAGTAHGHLRLRDCRVPVANRLGEEGDGLEVAFRGFLDPSRTAIGMTCVGAAERALELAADHALRRVTFGQPLAKRQIIQMWLAEMATDIEAARQLVLHAARRFDEGHPITVEAAMAKMFATEMLQRVTDKALQIHGGPGYFKSSEIERIYRDARMQRFEEGTSEIQKMVIARDVIDKAKKASEGSERRCW

SEQ ID NO: 708 - protein, 388 aa, Artificial
  Substituion in SEQ ID NO 698
MMRTLDEWKKDVDAYVAGPARAWSEHIEATGTVPDALWRELRDAGYLRLAAPPHLGGHGLSFTDYLDLLRRFAHTHGSIRVMVHVANSLWRSLAQKATPEQVERFVKPFVAGDIRVTFTLTEPNSGSGADIKTTARREGDEYVLNGEKWMIIFSDVADYFLLFCRLEGTSGGEGTLALLVPRDAPGLTVELMAPAMGIAGTAHGHLRLRDCRVPVANRLGDEGDGLEVAFRGFLDPSRTAIGMTCVGAAERALELAADHALRRVTFGQPLAKRQIIQMWLAEMATDIEAARQLVLHAARRFDEGHPITVEAAMAKMFATEMLQRVTDKALQIHGGPGYFKSSEIERIYRDARMQRFEEGTSEIQKMVIARDVIDKAKRASEGSERRCW

SEQ ID NO: 709 - protein, 388 aa, Artificial
  Substituion in SEQ ID NO 698
MMRTLDEWKKDVDAYVAGPARAWSEHIEATGTVPDALWRELRDAGYLRLAAPPHLGGHGLSFTDYLDLLRRFAHTHGSIRVMVHVANSLWRSLAQKATPEQVERFVRPFVAGDIRVTFTLTEPNSGSGADIKTTARREGDEYVLNGEKWMIIFSDVADYFLLFCRLEGTSGGEGTLALLVPRDAPGLTVELMAPAMGIAGTAHGHLRLRDCRVPVANRLGEEGDGLEVAFRGFLDPSRTAIGMTCVGAAERALELAADHALRRVTFGQPLAKRQIIQMWLAEMATDIEAARQLVLHAARRFDEGHPITVEAAMAKMFATEMLQRVTDKALQIHGGPGYFKSSEIERIYRDARMQRFEEGTSEIQKMVIARDVIDKAKRASEGSERRCW

SEQ ID NO: 710 - DNA, 1167 bp, Artificial
  Substituion in SEQ ID NO 699
atgatgcggacgctggacgagtggaagaaggacgtcgacgcttacgtcgcgggcccggccagggcgtggtctgagcatattgaggcgacggggacggtgccggacgccctgtggcgagagcttcgcgacgccggctacctgcggctcgccgccccgccccatctcggcgggcacgggctcagcttcacggattacctggatctcttgcgccgattcgcgcacacgcacgggtccatccgcgtgatggtgcacgtggcgaacagcctatggcgctcgctcgcgcagaaggcgacgccggagcaggtggagcggtttgtgaagccgtttgtcgcgggcgacatccgcgtgacgttcacactgacggagccgaattcgggctccggcgcggacatcaagacgacggcccggcgcgagggcgacgagtacgtcctgaacggcgaaaagtggatgatcatcttcagcgacgtggcggactacttcctgctcttctgccggttggaggggacgtcgggcggcgaagggacgattgcgctcctcgtcccgcgcgacgcgccgggcctcacggttgagctcatggcgccggccatgggcatcgcgggcacggcgcacgggcaccttcgcctgcgcgactgccgcgtacccgtcgccaaccgcctcggcgaggagggcgacggcctggaggtggcgttccgcggctttctggatccgtcccgcaccgccattggcatgacctgcgtcggcgcagcggagcgagcgctcgaactcgcggccgatcacgccctccggcgcgtcaccttcggccagccgctcgccaagcgccaaatcatccagatgtggctcgcggagatggcgacggacatcgaggcggcgcgccagctcgtcctccacgcggcccggcggttcgacgaaggccatcccatcaccgtggaggcggcgatggcgaagatgttcgcgacggagatgctgcagcgcgtgacggacaaggccctgcagattcacggcgggccgggttacttcaagtcgagcgagatcgagcggatctaccgggacgccaggatgcagcggttcgaggaaggcacgtcggagattcagaagatggtcattgcgcgcgacgtgatcgacaaggccaagcgggcctcagaagggagcgagcggagatgctggtga

SEQ ID NO: 711 - DNA, 1167 bp, Artificial
  Substituion in SEQ ID NO 699
atgatgcggacgctggacgagtggaagaaggacgtcgacgcttacgtcgcgggcccggccagggcgtggtctgagcatattgaggcgacggggacggtgccggacgccctgtggcgagagcttcgcgacgccggctacctgcggctcgccgccccgccccatctcggcgggcacgggctcagcttcacggattacctggatctcttgcgccgattcgcgcacacgcacgggtccatccgcgtgatggtgcacgtggcgaacagcctatggcgctcgctcgcgcagaaggcgacgccggagcaggtggagcggtttgtgaagccgtttgtcgcgggcgacatccgcgtgacgttcacactgacggagccgaattcgggctccggcgcggacatcaagacgacggcccggcgcgagggcgacgagtacgtcctgaacggcgaaaagtggatgatcatcttcagcgacgtggcggactacttcctgctcttctgccggattgaggggacgtcgggcggcgaagggacgctcgcgctcctcgtcccgcgcgacgcgccgggcctcacggttgagctcatggcgccggccatgggcatcgcgggcacggcgcacgggcaccttcgcctgcgcgactgccgcgtacccgtcgccaaccgcctcggcgaggagggcgacggcctggaggtggcgttccgcggctttctggatccgtcccgcaccgccattggcatgacctgcgtcggcgcagcggagcgagcgctcgaactcgcggccgatcacgccctccggcgcgtcaccttcggccagccgctcgccaagcgccaaatcatccagatgtggctcgcggagatggcgacggacatcgaggcggcgcgccagctcgtcctccacgcggcccggcggttcgacgaaggccatcccatcaccgtggaggcggcgatggcgaagatgttcgcgacggagatgctgcagcgcgtgacggacaaggccctgcagattcacggcgggccgggttacttcaagtcgagcgagatcgagcggatctaccgggacgccaggatgcagcggttcgaggaaggcacgtcggagattcagaagatggtcattgcgcgcgacgtgatcgacaaggccaagcgggcctcagaagggagcgagcggagatgctggtga

SEQ ID NO: 712 - DNA, 1167 bp, Artificial
  Substituion in SEQ ID NO 699
atgatgcggacgctggacgagtggaagaaggacgtcgacgcttacgtcgcgggcccggccagggcgtggtctgagcatattgaggcgacggggacggtgccggacgccctgtggcgagagcttcgcgacgccggctacctgcggctcgccgccccgccccatctcggcgggcacgggctcagcttcacggattacctggatctcttgcgccgattcgcgcacacgcacgggtccatccgcgtgatggtgcacgtggcgaacagcctatggcgctcgctcgcgcagaaggcgacgccggagcaggtggagcggtttgtgaagccgtttgtcgcgggcgacatccgcgtgacgttcacactgacggagccgaattcgggctccggcgcggacatcaagacgacggcccggcgcgagggcgacgagtacgtcctgaacggcgaaaagtggatgatcatcttcagcgacgtggcggactacttcctgctcttctgccggttggaggggacgtcgggcggcgaagggacgctcgcgctcctcgtcccgcgcgacgcgccgggcctcacggttgagctcatggcgccggccatgggcatcgcgggcacggcgcacgggcaccttcgcctgcgcgactgccgcgtacccgtcgccaaccgcctcggcgaggagggcgacggcctggaggtggcgttccgcggctttctggatccgtcccgcaccgccattggcatgacctgcgtcggcgcagcggagcgagcgctcgaactcgcggccgatcacgccctccggcgcgtcaccttcggccagccgctcgccaagcgccaaatcatccagatgtggctcgcggagatggcgacggacatcgaggcggcgcgccagctcgtcctccacgcggcccggcggttcgacgaaggccatcccatcaccgtggaggcggcgatggcgaagatgttcgcgacggagatgctgcagcgcgtgacggacaaggccctgcagattcacggcgggccgggttacttcaagtcgagcgagatcgagcggatctaccgggacgccaggatgcagcggttcgaggaaggcacgtcggagattcagaagatggtcattgcgcgcgacgtgatcgacaaggccaagaaagcctcagaagggagcgagcggagatgctggtga

SEQ ID NO: 713 - DNA, 1167 bp, Artificial
  Substituion in SEQ ID NO 699
atgatgcggacgctggacgagtggaagaaggacgtcgacgcttacgtcgcgggcccggccagggcgtggtctgagcatattgaggcgacggggacggtgccggacgccctgtggcgagagcttcgcgacgccggctacctgcggctcgccgccccgccccatctcggcgggcacgggctcagcttcacggattacctggatctcttgcgccgattcgcgcacacgcacgggtccatccgcgtgatggtgcacgtggcgaacagcctatggcgctcgctcgcgcagaaggcgacgccggagcaggtggagcggtttgtgaagccgtttgtcgcgggcgacatccgcgtgacgttcacactgacggagccgaattcgggctccggcgcggacatcaagacgacggcccggcgcgagggcgacgagtacgtcctgaacggcgaaaagtggatgatcatcttcagcgacgtggcggactacttcctgctcttctgccggttggaggggacgtcgggcggcgaagggacgctcgcgctcctcgtcccgcgcgacgcgccgggcctcacggttgagctcatggcgccggccatgggcatcgcgggcacggcgcacgggcaccttcgcctgcgcgactgccgcgtacccgtcgccaaccgcctcggcgatgagggcgacggcctggaggtggcgttccgcggctttctggatccgtcccgcaccgccattggcatgacctgcgtcggcgcagcggagcgagcgctcgaactcgcggccgatcacgccctccggcgcgtcaccttcggccagccgctcgccaagcgccaaatcatccagatgtggctcgcggagatggcgacggacatcgaggcggcgcgccagctcgtcctccacgcggcccggcggttcgacgaaggccatcccatcaccgtggaggcggcgatggcgaagatgttcgcgacggagatgctgcagcgcgtgacggacaaggccctgcagattcacggcgggccgggttacttcaagtcgagcgagatcgagcggatctaccgggacgccaggatgcagcggttcgaggaaggcacgtcggagattcagaagatggtcattgcgcgcgacgtgatcgacaaggccaagcgggcctcagaagggagcgagcggagatgctggtga

SEQ ID NO: 714 - DNA, 1167 bp, Artificial
  Substituion in SEQ ID NO 699
atgatgcggacgctggacgagtggaagaaggacgtcgacgcttacgtcgcgggcccggccagggcgtggtctgagcatattgaggcgacggggacggtgccggacgccctgtggcgagagcttcgcgacgccggctacctgcggctcgccgccccgccccatctcggcgggcacgggctcagcttcacggattacctggatctcttgcgccgattcgcgcacacgcacgggtccatccgcgtgatggtgcacgtggcgaacagcctatggcgctcgctcgcgcagaaggcgacgccggagcaggtggagcggtttgtgcgtccgtttgtcgcgggcgacatccgcgtgacgttcacactgacggagccgaattcgggctccggcgcggacatcaagacgacggcccggcgcgagggcgacgagtacgtcctgaacggcgaaaagtggatgatcatcttcagcgacgtggcggactacttcctgctcttctgccggttggaggggacgtcgggcggcgaagggacgctcgcgctcctcgtcccgcgcgacgcgccgggcctcacggttgagctcatggcgccggccatgggcatcgcgggcacggcgcacgggcaccttcgcctgcgcgactgccgcgtacccgtcgccaaccgcctcggcgaggagggcgacggcctggaggtggcgttccgcggctttctggatccgtcccgcaccgccattggcatgacctgcgtcggcgcagcggagcgagcgctcgaactcgcggccgatcacgccctccggcgcgtcaccttcggccagccgctcgccaagcgccaaatcatccagatgtggctcgcggagatggcgacggacatcgaggcggcgcgccagctcgtcctccacgcggcccggcggttcgacgaaggccatcccatcaccgtggaggcggcgatggcgaagatgttcgcgacggagatgctgcagcgcgtgacggacaaggccctgcagattcacggcgggccgggttacttcaagtcgagcgagatcgagcggatctaccgggacgccaggatgcagcggttcgaggaaggcacgtcggagattcagaagatggtcattgcgcgcgacgtgatcgacaaggccaagcgggcctcagaagggagcgagcggagatgctggtga

SEQ ID NO: 715 - protein, 393 aa, Alicyclobacillus acidocaldarius
MEVSRVDFTLPSELEEMRRTIRDFVEHEVEPLAMQIEEEDRVPDSVLEKSKELGLFGLSIPEEYGGIGLSMLGKCVIYEELGKTINGYTTIIGAHNGIGSVGIVEFGTKEQKEKYLPKMATGEWIGAFALTEPQAGSNAAAIKTTAVKKGDRYILNGQKIYITNAPYAHVFTVMAVTDPSKGAKGITSFIVERDFPGFRVGHIEKKMGLHGSHTAQIFFEDMEVPEENVLGREGEGYVNALKILANGRAGLAARCLGSCEYLLDKSLAFAHERIQFGKPIFEQQIIQHYLAEMALEIELLRTFVYRVAWMTDQKMNVIKEAAMLKLYGSEVYNRVADKAVQIHGGLGFIAEYPIERFYRDARITRIYEGTSEIQKNIIAAQLHKEYERTKADA

SEQ ID NO: 716 - DNA, 1182 bp, Alicyclobacillus acidocaldarius
gtggaggtgagtcgcgtggactttacgctcccatccgagctggaagagatgaggcggaccattcgcgactttgtggaacacgaggttgaaccgctcgccatgcagattgaggaagaggatcgcgtgccggacagcgtgctggaaaaatcgaaggagcttggactgtttggcctcagcatccccgaggagtacggtggcatcggcctcagcatgctgggcaagtgcgtcatctacgaggagctcggcaagaccatcaacggctacacgaccatcatcggcgcgcacaacggcattggttcggtcggcatcgtggagtttggcaccaaggagcagaaggagaaatacctgcccaagatggcgacgggtgagtggatcggcgcgtttgcgctcaccgagccgcaggccggatcgaacgcggcggccattaagacgacggcggtaaagaagggcgataggtacatcctcaacggccagaagatctacatcacaaacgcgccgtatgcgcacgtgttcacggtgatggcggtcacggatccgtccaaaggggcgaagggcatcacctcgttcatcgtcgaacgcgactttccaggttttcgtgtgggacacattgaaaagaagatggggctgcatggatcacacacggcgcagatcttcttcgaggacatggaggttccggaggagaacgtcctgggccgagagggcgaaggatatgtcaacgcgctcaagattctggccaacggccgagcagggctcgcggcgaggtgcctgggttcctgtgaatatctgctggacaaatcgctggcgtttgcgcacgagcgcatccagttcggcaagcccatctttgaacagcagatcatccagcactacctcgcggagatggcgctcgagatcgaactgctgcgcacctttgtctaccgcgtggcgtggatgacggatcagaaaatgaacgtcatcaaggaagctgcgatgctgaagctatacgggtccgaggtctacaaccgcgtggcggacaaggcggtccagatccacggcgggctcggtttcatcgcggagtatcccatcgagcggttctatcgcgatgcgcgcatcacgaggatctacgagggaacgtccgagatccaaaagaacatcattgccgcacagctgcacaaggagtacgagcgcaccaaggcggatgcgtga

SEQ ID NO: 717 - protein, 386 aa, Geobacillus kaustophilus HTA426
MDFTLPAEIEFLKENVRKFVREVVEPVAMDIEENDQIPQDIIEKSKEMGLFGLSIPEEYGGLGLSMVGKCAIYEELGKTHNGYTTLIGAHTGIGTVGIVELGTEEQKQRYLPKMATGEWIGAFALTEPSAGSNAAAIKTTAVRKGDRYIINGSKHYITNAVDAHVFTVMAVTDPSKGPKGITSFIVEKDFPGFIVGKVERKMGLRGSHSAELFFDNLEVPAENVLGREGEGYVNALKILANGRAGLAARNLGSCIRLLEYCMEYAEQREQFGKPIIEQQAIQHMLAEMSMLIEVLRSTVYRVAWMVDQKMRVVKEAAIAKLFGSEVYNKIADMAVQIHGGLGYMKDYPIERYFRDARITKIYEGTSEIQRNIIASELRKEYGKVRA

SEQ ID NO: 718 - protein, 385 aa, Geobacillus thermodenitrificans NG80-2
MEFTLPAEIEFLKENVRKFVREVVEPVAMDIEENDHIPEDIIEKSKEMGLFGLSIPEEYGGLGLSMVGKCAIYEELGKTHNGYTTLIGAHTGIGTVGIVELGTEEQKQRYLPKMATGEWIGAFALTEPSAGSNAAALKTTAVRKGDRYIINGSKHYITNAVDAHVFTVMAVTDPSKGPKGITSFIVEKDFPGFTIGNVERKMGLRGSHSAELFFDNLEVPVENVLGKEGEGYINALKILANGRAGLAARNLGSCIRLLEYCMEYAEQREQFGKPIIEQQAIQHMLAEMSMLIEVLRSTVYRVAWMVDQKMRVVKEAAIAKLFGSEVYNKIADMAVQIHGGLGYMKDYPIERYFRDARITKIYEGTSEIQRNIIANELRKEYGKVR

SEQ ID NO: 719 - protein, 382 aa, Carboxydothermus hydrogenoformans Z-2901
MDFTISEELQMMVQTVKDFVDNEVDPISQQIDEEDRVPEEIIQKARELGLFGLSIPEEYGGVGSIGMLGKCIIYEQLGRTANGFTTLIGAHTGIGTTGIVELGTEEQKRRYLPDLASGKKLAAFALTEPEAGSDAASIRTTAVKKGDRYILNGVKHFITNGPDADVFTIIAVTDKSKGAKGGITAFIVEKNFPGFKVGTIEKKMGLRGSHTSEIILEDCEVPEENVLGNVGEGYINALKILAKGRVGLAARCVGSMQKLLELSTRYAQQRVQFGKPISSFQAIQHMLAEMAVDIEATRWFAYRVAWLVDQGAKVIKEAAAVKLFASEAYGRVVDKAVQIFGGMGYMKEFPIERYYRDARITRIYEGTSEIQKNIIASQILKE

SEQ ID NO: 720 - protein, 381 aa, Oceanobacillus iheyensis HTE831
MNFELDEDIQIIKDNVRNFIQTEVEQVADNIERNNKIPDRIIELSKQMGLFGLSIPEQYGGLGIGMVGKCALYEEIGVTHNGYTTLIGAHTGIGTVGIVEMGNEQQKQKYLPLMASGEKIGAFALTEPEAGSNASALKTSAIKKKDKYILNGTKHYITNATEAEVFTVMAVTDPAKGAKGISSFIVEKSNLGFHVGAVEEKMGLKGSHSAEIILDDCEVSVENLLGEEGQGYVNALKILTNGRAGLAARNLGSCQKLLDMSTTYAIERQQFGTSIIDHQAVAHMLAEMAVEIEALRALTYKVAWMVDNGENVIKEAAMLKLYGSEVYNRVADKAVQVHGGIGYISDFPVERYYRDARITRIYEGTSEIQKNIIAGQLKKHY

SEQ ID NO: 721 - protein, 378 aa, Deinococcus radiodurans R1
MDFNLPDDLREVQATIRDFMLTRVEDRAQEIEHTNSVPPELIKEAADLGLFGLSIPEEYGGVGLSSLGRCAVYEAMGQGHMGFGGMISAHASIGTSGLVKLGNEEQKQRFLPRMAAGECIAGFAITEPSSGSDAGNIRTKAVKKGDVYVLNGTKHYISNAPIAGLLTVIAITDPAQGSRGMSAFLVEPQSTPGVSIGKIDEKMGQKGALSAEVIFEDAEIPAANLLGPENRGYREALGILTNGRVGIAARSTGAMQRLLDLSVAHAQTREQFGKPIAEFQAVQFMLAEMEVAIQTSRVLWQKVAWMVDQGQDVKRMASVAKYHATEMLSQVADKAVQVAGGMGYVKDAPFERFYRDQRLLRIYEGTSEIQKVIIAAEL

SEQ ID NO: 722 - protein, 393 aa, Artificial
  Substituion in SEQ ID NO 715
MDVSRVDFTLPSELEEMRRTIRDFVEHEVEPLAMQIEEEDRVPDSVLEKSKELGLFGLSIPEEYGGIGLSMLGKCVIYEELGKTINGYTTIIGAHNGIGSVGIVEFGTKEQKEKYLPKMATGEWIGAFALTEPQAGSNAAAIKTTAVKKGDRYILNGQKIYITNAPYAHVFTVMAVTDPSKGAKGITSFIVERDFPGFRVGHIEKKMGLHGSHTAQIFFEDMEVPEENVLGREGEGYVNALKILANGRAGLAARCLGSCEYLLDKSLAFAHERIQFGKPIFEQQIIQHYLAEMALEIELLRTFVYRVAWMTDQKMNVIKEAAMLKLYGSEVYNRVADKAVQIHGGLGFIAEYPIERFYRDARITRIYEGTSEIQKNIIAAQLHKEYERTKADA

SEQ ID NO: 723 - protein, 393 aa, Artificial
  Substituion in SEQ ID NO 715
MEVSRVDFTLPSELEEMRRTIRDFVEHEVEPLAMQIEEEDRVPDSVLEKSKELGLFGLSIPEEYGGIGLSMLGKCVIYEELGKTINGYTTIIGAHNGIGSVGIVEFGTKEQKEKYLPKMATGEWIGAFALTEPQAGSNAAAIKTTAVKKGDRYILNGQKIYITNAPYAHVFTVMAVTDPSKGAKGITSFIVERDFPGFRVGHIEKKMGLHGSHTAQIFFEDMEVPEENVLGREGEGYVNALKILANGRAGLAARCLGSCEYLLDKSLAFAHERIQFGKPIFEQQIIQHYLAEMALEIEILRTFVYRVAWMTDQKMNVIKEAAMLKLYGSEVYNRVADKAVQIHGGLGFIAEYPIERFYRDARITRIYEGTSEIQKNIIAAQLHKEYERTKADA

SEQ ID NO: 724 - protein, 393 aa, Artificial
  Substituion in SEQ ID NO 715
MEVSRVDFTLPSELEEMRRTIRDFVEHEVEPLAMQIEEEDKVPDSVLEKSKELGLFGLSIPEEYGGIGLSMLGKCVIYEELGKTINGYTTIIGAHNGIGSVGIVEFGTKEQKEKYLPKMATGEWIGAFALTEPQAGSNAAAIKTTAVKKGDRYILNGQKIYITNAPYAHVFTVMAVTDPSKGAKGITSFIVERDFPGFRVGHIEKKMGLHGSHTAQIFFEDMEVPEENVLGREGEGYVNALKILANGRAGLAARCLGSCEYLLDKSLAFAHERIQFGKPIFEQQIIQHYLAEMALEIELLRTFVYRVAWMTDQKMNVIKEAAMLKLYGSEVYNRVADKAVQIHGGLGFIAEYPIERFYRDARITRIYEGTSEIQKNIIAAQLHKEYERTKADA

SEQ ID NO: 725 - protein, 393 aa, Artificial
  Substituion in SEQ ID NO 715
MEVSRVDFTLPSELEEMRRTIRDFVEHEVEPLAMQIEEEDRVPDSVLEKSKELGLFGLSIPEEYGGIGLSMLGKCVIYEELGKTINGYTTIIGAHNGIGSVGIVEFGTKEQKEKYLPKMATGEWIGAFALTEPQAGSNAAAIKTTAVKKGDRYILNGQKIYITNAPYAHVFTVMAVTDPSKGAKGITSFIVERDFPGFRVGHIEKKMGLHGSHTAQIFFEDMEVPDENVLGREGEGYVNALKILANGRAGLAARCLGSCEYLLDKSLAFAHERIQFGKPIFEQQIIQHYLAEMALEIELLRTFVYRVAWMTDQKMNVIKEAAMLKLYGSEVYNRVADKAVQIHGGLGFIAEYPIERFYRDARITRIYEGTSEIQKNIIAAQLHKEYERTKADA

SEQ ID NO: 726 - protein, 393 aa, Artificial
  Substituion in SEQ ID NO 715
MEVSRVDFTLPSELEEMRRTIRDFVEHEVEPLAMQIEEEDRVPDSVLEKSKELGLFGLSIPEEYGGIGLSMLGKCVIYEELGKTINGYTTIIGAHNGIGSVGIVEFGTKEQKEKYLPKMATGEWIGAFALTEPQAGSNAAAIKTTAVKKGDRYILNGQKIYITNAPYAHVFTVMAVTDPSKGAKGITSFIVERDFPGFRVGHIEKKMGLHGSHTAQIFFEDMEVPEENVLGREGEGYVNALKILANGRAGLAARCLGSCEYLLDKSIAFAHERIQFGKPIFEQQIIQHYLAEMALEIELLRTFVYRVAWMTDQKMNVIKEAAMLKLYGSEVYNRVADKAVQIHGGLGFIAEYPIERFYRDARITRIYEGTSEIQKNIIAAQLHKEYERTKADA

SEQ ID NO: 727 - DNA, 1182 bp, Artificial
  Substituion in SEQ ID NO 716
gtggatgtgagtcgcgtggactttacgctcccatccgagctggaagagatgaggcggaccattcgcgactttgtggaacacgaggttgaaccgctcgccatgcagattgaggaagaggatcgcgtgccggacagcgtgctggaaaaatcgaaggagcttggactgtttggcctcagcatccccgaggagtacggtggcatcggcctcagcatgctgggcaagtgcgtcatctacgaggagctcggcaagaccatcaacggctacacgaccatcatcggcgcgcacaacggcattggttcggtcggcatcgtggagtttggcaccaaggagcagaaggagaaatacctgcccaagatggcgacgggtgagtggatcggcgcgtttgcgctcaccgagccgcaggccggatcgaacgcggcggccattaagacgacggcggtaaagaagggcgataggtacatcctcaacggccagaagatctacatcacaaacgcgccgtatgcgcacgtgttcacggtgatggcggtcacggatccgtccaaaggggcgaagggcatcacctcgttcatcgtcgaacgcgactttccaggttttcgtgtgggacacattgaaaagaagatggggctgcatggatcacacacggcgcagatcttcttcgaggacatggaggttccggaggagaacgtcctgggccgagagggcgaaggatatgtcaacgcgctcaagattctggccaacggccgagcagggctcgcggcgaggtgcctgggttcctgtgaatatctgctggacaaatcgctggcgtttgcgcacgagcgcatccagttcggcaagcccatctttgaacagcagatcatccagcactacctcgcggagatggcgctcgagatcgaactgctgcgcacctttgtctaccgcgtggcgtggatgacggatcagaaaatgaacgtcatcaaggaagctgcgatgctgaagctatacgggtccgaggtctacaaccgcgtggcggacaaggcggtccagatccacggcgggctcggtttcatcgcggagtatcccatcgagcggttctatcgcgatgcgcgcatcacgaggatctacgagggaacgtccgagatccaaaagaacatcattgccgcacagctgcacaaggagtacgagcgcaccaaggcggatgcgtga

SEQ ID NO: 728 - DNA, 1182 bp, Artificial
  Substituion in SEQ ID NO 716
gtggaggtgagtcgcgtggactttacgctcccatccgagctggaagagatgaggcggaccattcgcgactttgtggaacacgaggttgaaccgctcgccatgcagattgaggaagaggatcgcgtgccggacagcgtgctggaaaaatcgaaggagcttggactgtttggcctcagcatccccgaggagtacggtggcatcggcctcagcatgctgggcaagtgcgtcatctacgaggagctcggcaagaccatcaacggctacacgaccatcatcggcgcgcacaacggcattggttcggtcggcatcgtggagtttggcaccaaggagcagaaggagaaatacctgcccaagatggcgacgggtgagtggatcggcgcgtttgcgctcaccgagccgcaggccggatcgaacgcggcggccattaagacgacggcggtaaagaagggcgataggtacatcctcaacggccagaagatctacatcacaaacgcgccgtatgcgcacgtgttcacggtgatggcggtcacggatccgtccaaaggggcgaagggcatcacctcgttcatcgtcgaacgcgactttccaggttttcgtgtgggacacattgaaaagaagatggggctgcatggatcacacacggcgcagatcttcttcgaggacatggaggttccggaggagaacgtcctgggccgagagggcgaaggatatgtcaacgcgctcaagattctggccaacggccgagcagggctcgcggcgaggtgcctgggttcctgtgaatatctgctggacaaatcgctggcgtttgcgcacgagcgcatccagttcggcaagcccatctttgaacagcagatcatccagcactacctcgcggagatggcgctcgagatcgaaattctgcgcacctttgtctaccgcgtggcgtggatgacggatcagaaaatgaacgtcatcaaggaagctgcgatgctgaagctatacgggtccgaggtctacaaccgcgtggcggacaaggcggtccagatccacggcgggctcggtttcatcgcggagtatcccatcgagcggttctatcgcgatgcgcgcatcacgaggatctacgagggaacgtccgagatccaaaagaacatcattgccgcacagctgcacaaggagtacgagcgcaccaaggcggatgcgtga

SEQ ID NO: 729 - DNA, 1182 bp, Artificial
  Substituion in SEQ ID NO 716
gtggaggtgagtcgcgtggactttacgctcccatccgagctggaagagatgaggcggaccattcgcgactttgtggaacacgaggttgaaccgctcgccatgcagattgaggaagaggataaagtgccggacagcgtgctggaaaaatcgaaggagcttggactgtttggcctcagcatccccgaggagtacggtggcatcggcctcagcatgctgggcaagtgcgtcatctacgaggagctcggcaagaccatcaacggctacacgaccatcatcggcgcgcacaacggcattggttcggtcggcatcgtggagtttggcaccaaggagcagaaggagaaatacctgcccaagatggcgacgggtgagtggatcggcgcgtttgcgctcaccgagccgcaggccggatcgaacgcggcggccattaagacgacggcggtaaagaagggcgataggtacatcctcaacggccagaagatctacatcacaaacgcgccgtatgcgcacgtgttcacggtgatggcggtcacggatccgtccaaaggggcgaagggcatcacctcgttcatcgtcgaacgcgactttccaggttttcgtgtgggacacattgaaaagaagatggggctgcatggatcacacacggcgcagatcttcttcgaggacatggaggttccggaggagaacgtcctgggccgagagggcgaaggatatgtcaacgcgctcaagattctggccaacggccgagcagggctcgcggcgaggtgcctgggttcctgtgaatatctgctggacaaatcgctggcgtttgcgcacgagcgcatccagttcggcaagcccatctttgaacagcagatcatccagcactacctcgcggagatggcgctcgagatcgaactgctgcgcacctttgtctaccgcgtggcgtggatgacggatcagaaaatgaacgtcatcaaggaagctgcgatgctgaagctatacgggtccgaggtctacaaccgcgtggcggacaaggcggtccagatccacggcgggctcggtttcatcgcggagtatcccatcgagcggttctatcgcgatgcgcgcatcacgaggatctacgagggaacgtccgagatccaaaagaacatcattgccgcacagctgcacaaggagtacgagcgcaccaaggcggatgcgtga

SEQ ID NO: 730 - DNA, 1182 bp, Artificial
  Substituion in SEQ ID NO 716
gtggaggtgagtcgcgtggactttacgctcccatccgagctggaagagatgaggcggaccattcgcgactttgtggaacacgaggttgaaccgctcgccatgcagattgaggaagaggatcgcgtgccggacagcgtgctggaaaaatcgaaggagcttggactgtttggcctcagcatccccgaggagtacggtggcatcggcctcagcatgctgggcaagtgcgtcatctacgaggagctcggcaagaccatcaacggctacacgaccatcatcggcgcgcacaacggcattggttcggtcggcatcgtggagtttggcaccaaggagcagaaggagaaatacctgcccaagatggcgacgggtgagtggatcggcgcgtttgcgctcaccgagccgcaggccggatcgaacgcggcggccattaagacgacggcggtaaagaagggcgataggtacatcctcaacggccagaagatctacatcacaaacgcgccgtatgcgcacgtgttcacggtgatggcggtcacggatccgtccaaaggggcgaagggcatcacctcgttcatcgtcgaacgcgactttccaggttttcgtgtgggacacattgaaaagaagatggggctgcatggatcacacacggcgcagatcttcttcgaggacatggaggttccggatgagaacgtcctgggccgagagggcgaaggatatgtcaacgcgctcaagattctggccaacggccgagcagggctcgcggcgaggtgcctgggttcctgtgaatatctgctggacaaatcgctggcgtttgcgcacgagcgcatccagttcggcaagcccatctttgaacagcagatcatccagcactacctcgcggagatggcgctcgagatcgaactgctgcgcacctttgtctaccgcgtggcgtggatgacggatcagaaaatgaacgtcatcaaggaagctgcgatgctgaagctatacgggtccgaggtctacaaccgcgtggcggacaaggcggtccagatccacggcgggctcggtttcatcgcggagtatcccatcgagcggttctatcgcgatgcgcgcatcacgaggatctacgagggaacgtccgagatccaaaagaacatcattgccgcacagctgcacaaggagtacgagcgcaccaaggcggatgcgtga

SEQ ID NO: 731 - DNA, 1182 bp, Artificial
  Substituion in SEQ ID NO 716
gtggaggtgagtcgcgtggactttacgctcccatccgagctggaagagatgaggcggaccattcgcgactttgtggaacacgaggttgaaccgctcgccatgcagattgaggaagaggatcgcgtgccggacagcgtgctggaaaaatcgaaggagcttggactgtttggcctcagcatccccgaggagtacggtggcatcggcctcagcatgctgggcaagtgcgtcatctacgaggagctcggcaagaccatcaacggctacacgaccatcatcggcgcgcacaacggcattggttcggtcggcatcgtggagtttggcaccaaggagcagaaggagaaatacctgcccaagatggcgacgggtgagtggatcggcgcgtttgcgctcaccgagccgcaggccggatcgaacgcggcggccattaagacgacggcggtaaagaagggcgataggtacatcctcaacggccagaagatctacatcacaaacgcgccgtatgcgcacgtgttcacggtgatggcggtcacggatccgtccaaaggggcgaagggcatcacctcgttcatcgtcgaacgcgactttccaggttttcgtgtgggacacattgaaaagaagatggggctgcatggatcacacacggcgcagatcttcttcgaggacatggaggttccggaggagaacgtcctgggccgagagggcgaaggatatgtcaacgcgctcaagattctggccaacggccgagcagggctcgcggcgaggtgcctgggttcctgtgaatatctgctggacaaatcgattgcgtttgcgcacgagcgcatccagttcggcaagcccatctttgaacagcagatcatccagcactacctcgcggagatggcgctcgagatcgaactgctgcgcacctttgtctaccgcgtggcgtggatgacggatcagaaaatgaacgtcatcaaggaagctgcgatgctgaagctatacgggtccgaggtctacaaccgcgtggcggacaaggcggtccagatccacggcgggctcggtttcatcgcggagtatcccatcgagcggttctatcgcgatgcgcgcatcacgaggatctacgagggaacgtccgagatccaaaagaacatcattgccgcacagctgcacaaggagtacgagcgcaccaaggcggatgcgtga

SEQ ID NO: 732 - protein, 389 aa, Alicyclobacillus acidocaldarius
MTHVTSIGAKGEAPHILLAPDSFKGSLTAREAAEAMAEGVSRACPSAQLALVPIADGGEGTLAAIATSTRARWLSTEVTAASGQPKQGRFLALPDGTAVVECAEAVGLPEALRSGADVWRRTTVGVGEMIRHALETGHRRIAVALGGSATNDAGVGMLAALGVRLLDDAGQDVPPVPAEFHRVARVDVSGLDERLRGAEMLAVCDVDNPLTGENGATTVFGPQKGVSTHDVPRLDEALAHLAARCEAAFGCKAADLPGAGAAGGLGFALYLLGAARVSGIDFVLDAVGFDHALERAALVLTGEGRTDAQTAHGKAVAGVARRAKARGVPVFCISGAIGPGAERLYDHGVSALFATAPGPIALDEAMANAKALLAAAAENAVRAWLAGRP

SEQ ID NO: 733 - DNA, 1170 bp, Alicyclobacillus acidocaldarius
gtgacgcacgtgacatccatcggcgcgaaaggtgaagctccccacatcctgctcgcccccgattccttcaagggctcgctcaccgcgcgcgaggcggctgaggcgatggccgagggcgtgagccgggcgtgtccatccgcccagttggcgcttgtccccatcgcggacggcggcgaaggcacgcttgcggccatcgccacctcgacccgcgcgcggtggctatcgaccgaggttacggcggcgagcggccaacctaagcaaggccgtttccttgccctccccgatggcaccgccgtcgtcgagtgcgcggaggccgtcggcctgccggaggccctccgttcgggcgcggacgtctggcgccggaccacggtcggggtcggcgagatgatccggcacgcgctcgagacggggcatcgccgcatcgcggtggcgctcgggggatccgccacgaacgacgcgggcgtcggcatgctcgcggcgctcggtgtgcgattactcgatgatgcgggccaggacgtgcccccggtgccggcggagtttcaccgcgtggcgcgcgtcgacgtgtctggcctcgacgagcgcctccgcggcgccgagatgctcgccgtgtgcgacgtggataacccgctcacgggcgaaaacggggccaccaccgtcttcggcccgcagaagggcgtctcgacccacgacgtgccgcgtctagacgaggcgctcgcgcacctggccgcgcgctgcgaggcggcctttggctgcaaagcggcggacctgcccggcgcaggcgcggcggggggccttggcttcgcgctctaccttcttggcgccgcgcgggtgtccggcatcgactttgtgctggacgcggtcgggttcgatcacgcccttgaacgtgccgcgctcgtcctcaccggcgaaggccgcacggatgcgcagacggcccacggcaaggcggtggctggcgtggcccggcgcgccaaagcccgcggcgtgcctgtgttctgcatctccggggccatcggcccgggggccgagcgcctgtacgatcacggcgtctccgcgctcttcgccaccgcgcccgggcccatcgcgctggacgaggccatggcgaacgccaaggcgctgcttgcggctgctgcggaaaacgccgtgcgtgcgtggctcgctggacggccttag

SEQ ID NO: 734 - protein, 351 aa, Pelobacter propionicus DSM 2379
IIIAPDSYKGSLSAVEVAEAMARGIVSVFPDAEIVSLPVADGGEGTVEALVAATSGRFVCQEVSGPLGEPVMARWGILGDGATAVIEMAAASGLPLVAPERRNPLRASTCGTGELIRAALDAGLRRLIVGIGGSATNDGGAGMARALGVRFLDADGTELPEGGAALARLARVDLDGLDPRLVETSLQVACDVTNPLCGENGASVIYGPQKGATPEMVRELDRALEHYSQVVEQAIARNVSDQAGSGAAGGLGAGLRYFTNASLLPGVKIVLDAVGFAEALKTADLVITGEGCSDAQTAHGKAPLGVARLARNGGVPVICLSGGLGAGAEQLLEHGIDALLGIVSCPMPLED

SEQ ID NO: 735 - protein, 351 aa, Symbiobacterium thermophilum IAM 14863
IIVAPDSFKGSLTALKAAEAMRQGVLDAMPDAEVVALPMADGGEGTTQALVAATGGQLVEAEVTGPLGEPVRAAFGLLGDGDTAVIEMAAASGLLLVPPERRDPKVTTTYGTGELIRAALDRGVRRILVGIGGSATNDGGVGMAQALGGRFLKADGSPVDRGGAALLELERIDLSGLDPRLKGVELMVACDVDNPLTGPRGAAAVYGPQKGATAEDVALLDRALTRLADVMVRDLGRDVRNLPGAGAAGGLGAGLMGFLGARLRPGIDVVMEVTGLRRQLQGAALLLTGEGRTDGQTLAGKVPLGLARAAAPCGVPVVVISGAVTDDADALLEQGVAALLSTAPGPVTLDE

SEQ ID NO: 736 - protein, 350 aa, Bordetella petrii
IIIAPDSFKESLSAPDAAAAIERGVKQAFPGARTLCVPMADGGEGTVAAVLAATGGQWRTTPVSGALGEPMQAAWGWLDDSTAVIEMAAAAGLEQTPPERRDPLRASSGGVGELLRAALDAGARRIILGLGGSATNDGGAGMLAALGVRFLDANGLDLPPGGAALQQLARIDVQGLDPRLAGVQIDIASDVDNPLCGPQGASHTFGPQKGASPEQVALLDRSLARLADVCARDLGRDMRDAPGAGAAGGLGYAAHAFLNARFRPGVELVAELGKLAQAMEGAALAFTGEGRMDAQTLRGKTPAGVARIARRAGVPVVALAGSLGEGYQDLHAGGITAAFSLAPGPVSLQQ

SEQ ID NO: 737 - protein, 351 aa, Thermosinus carboxydivorans Nor1
VVIAPDSFKGSVSALGVANAVANGVRAVFPDAEIIKVPIADGGEGTVEALVTATGGQIVTREVVGPLGEPVMAHWGVLGDGDTAVIEMAAASGLTLVPKEKRDPRITTTYGTGQLIKAVLDRGIRKIIIGIGGSATNDGGTGMAKALGARFLDASGQELPPGGAALARLAKIDLSGLDERLRTTTILVACDVDNPLCGPRGASAVYGPQKGATPEMVKELDAALKNFAAVATVATGKDVADYPGAGAAGGLGAGLLFFTGAQLRPGVEIVLETTGFASLVATADLVITGEGRTDFQTAYGKAPVGVAKVAKQYGVPVVCLSGGLGDGADDVLAQGVDALMSVVPQPMALDE

SEQ ID NO: 738 - protein, 350 aa, Moorella thermoacetica ATCC 39073
IVIAPDSFKESLSAPEVAAAIAQGIHRVLPEVETVNVPMADGGEGLTATLVAATGGREMTATVTGPLGEPVQASWGILGDGITAVVEMAQASGLPLVPREKRNPLVTTTYGTGELIHQALEAGCRRLIVGIGGSATNDGGAGMARALGVKLLDAEGADIPPGAGGLERLERIDIQGLDPRVKEVEILVACDVDNPLCGPRGASAVYGPQKGATPEMIPRLDAALARLADIVARDLKVDVRELPGAGAAGGLGAGLVAFLGATLRRGIELVIEAVNLDGILAAGADLVITGEGEINRQTAYGKVPAGVAGVAAKYGIPVVALVGSIGEGASAVYDHGIQGFMSIVPRPVPL

SEQ ID NO: 739 - protein, 389 aa, Artificial
  Substituion in SEQ ID NO 732
MTHVTSIGAKGEAPHILLAPDSFKGSLTAREAAEAMAEGVSKACPSAQLALVPIADGGEGTLAAIATSTRARWLSTEVTAASGQPKQGRFLALPDGTAVVECAEAVGLPEALRSGADVWRRTTVGVGEMIRHALETGHRRIAVALGGSATNDAGVGMLAALGVRLLDDAGQDVPPVPAEFHRVARVDVSGLDERLRGAEMLAVCDVDNPLTGENGATTVFGPQKGVSTHDVPRLDEALAHLAARCEAAFGCKAADLPGAGAAGGLGFALYLLGAARVSGIDFVLDAVGFDHALERAALVLTGEGRTDAQTAHGKAVAGVARRAKARGVPVFCISGAIGPGAERLYDHGVSALFATAPGPIALDEAMANAKALLAAAAENAVRAWLAGRP

SEQ ID NO: 740 - protein, 389 aa, Artificial
  Substituion in SEQ ID NO 732
MTHVTSIGAKGEAPHILLAPDSFKGSLTAREAAEAMAEGVSRACPSAQLALVPIADGGEGTLAAIATSTRARWLSTEVTAASGQPKQGRFLALPDGTAVVECAEAVGLPEALRSGADVWRRTTVGVGEMIRHALETGHRRIAVALGGSATNDAGVGMLAALGVRLLDDAGQDVPPVPAEFHRVARVDVSGLDERLRGAEMLAVCDVDNPLTGENGATTVFGPQKGVSTHDVPRLDEALAHLAARCEAAFGCKAADLPGAGAAGGLGFALYLLGAARVSGIDFVLDAVGFDHALERAALVLTGEGKTDAQTAHGKAVAGVARRAKARGVPVFCISGAIGPGAERLYDHGVSALFATAPGPIALDEAMANAKALLAAAAENAVRAWLAGRP

SEQ ID NO: 741 - protein, 389 aa, Artificial
  Substituion in SEQ ID NO 732
MTHVTSIGAKGEAPHILLAPDSFKGSLTAREAAEAMAEGVSRACPSAQLALVPIADGGEGTLAAIATSTRARWLSTEVTAASGQPKQGRFLALPDGTAVVECAEAVGLPEALRSGADVWRRTTVGVGEMIRHALETGHRRIAVALGGSATNDAGVGMLAALGVRLLDDAGQDVPPVPAEFHRVARVDVSGLDERLRGAEMLAVCDVDNPLTGENGATTVFGPQKGVSTHDVPRLDEALAHLAARCEAAFGCKAADLPGAGAAGGLGFALYLLGAARVSGIDFVLDAVGFDHALERAALVLTGEGRTDAQTAHGKAVAGVARRAKARGVPVFCISGAIGPGAERLYDHGVSALFATAPGPIALDEAMANAKALLAAAAEQAVRAWLAGRP

SEQ ID NO: 742 - protein, 389 aa, Artificial
  Substituion in SEQ ID NO 732
MTHVTSIGAKGEAPHILLAPDSFKGSLTAREAAEAMAEGVSRACPSAQLALVPIADGGEGTLAAIATSTRARWLSTEVTAASGQPKQGRFLALPDGTAVVECAEAVGLPEALRSGADVWRRTTVGVGEMIRHALETGHRRIAVALGGSATNDAGVGMLAALGVRLLDDAGQDVPPVPAEFHRVARVDVSGLDERLRGAEMLAVCDVENPLTGENGATTVFGPQKGVSTHDVPRLDEALAHLAARCEAAFGCKAADLPGAGAAGGLGFALYLLGAARVSGIDFVLDAVGFDHALERAALVLTGEGRTDAQTAHGKAVAGVARRAKARGVPVFCISGAIGPGAERLYDHGVSALFATAPGPIALDEAMANAKALLAAAAENAVRAWLAGRP

SEQ ID NO: 743 - protein, 389 aa, Artificial
  Substituion in SEQ ID NO 732
MTHVTSIGAKGEAPHILLAPDSFKGSLTAREAAEAMAEGVSRACPSAQLALVPIADGGEGTLAAIATSTRARWLSTEVTAASGQPKQGRFLALPDGTAVVECAEAIGLPEALRSGADVWRRTTVGVGEMIRHALETGHRRIAVALGGSATNDAGVGMLAALGVRLLDDAGQDVPPVPAEFHRVARVDVSGLDERLRGAEMLAVCDVDNPLTGENGATTVFGPQKGVSTHDVPRLDEALAHLAARCEAAFGCKAADLPGAGAAGGLGFALYLLGAARVSGIDFVLDAVGFDHALERAALVLTGEGRTDAQTAHGKAVAGVARRAKARGVPVFCISGAIGPGAERLYDHGVSALFATAPGPIALDEAMANAKALLAAAAENAVRAWLAGRP

SEQ ID NO: 744 - DNA, 1170 bp, Artificial
  Substituion in SEQ ID NO 733
gtgacgcacgtgacatccatcggcgcgaaaggtgaagctccccacatcctgctcgcccccgattccttcaagggctcgctcaccgcgcgcgaggcggctgaggcgatggccgagggcgtgagcaaagcgtgtccatccgcccagttggcgcttgtccccatcgcggacggcggcgaaggcacgcttgcggccatcgccacctcgacccgcgcgcggtggctatcgaccgaggttacggcggcgagcggccaacctaagcaaggccgtttccttgccctccccgatggcaccgccgtcgtcgagtgcgcggaggccgtcggcctgccggaggccctccgttcgggcgcggacgtctggcgccggaccacggtcggggtcggcgagatgatccggcacgcgctcgagacggggcatcgccgcatcgcggtggcgctcgggggatccgccacgaacgacgcgggcgtcggcatgctcgcggcgctcggtgtgcgattactcgatgatgcgggccaggacgtgcccccggtgccggcggagtttcaccgcgtggcgcgcgtcgacgtgtctggcctcgacgagcgcctccgcggcgccgagatgctcgccgtgtgcgacgtggataacccgctcacgggcgaaaacggggccaccaccgtcttcggcccgcagaagggcgtctcgacccacgacgtgccgcgtctagacgaggcgctcgcgcacctggccgcgcgctgcgaggcggcctttggctgcaaagcggcggacctgcccggcgcaggcgcggcggggggccttggcttcgcgctctaccttcttggcgccgcgcgggtgtccggcatcgactttgtgctggacgcggtcgggttcgatcacgcccttgaacgtgccgcgctcgtcctcaccggcgaaggccgcacggatgcgcagacggcccacggcaaggcggtggctggcgtggcccggcgcgccaaagcccgcggcgtgcctgtgttctgcatctccggggccatcggcccgggggccgagcgcctgtacgatcacggcgtctccgcgctcttcgccaccgcgcccgggcccatcgcgctggacgaggccatggcgaacgccaaggcgctgcttgcggctgctgcggaaaacgccgtgcgtgcgtggctcgctggacggccttag

SEQ ID NO: 745 - DNA, 1170 bp, Artificial
  Substituion in SEQ ID NO 733
gtgacgcacgtgacatccatcggcgcgaaaggtgaagctccccacatcctgctcgcccccgattccttcaagggctcgctcaccgcgcgcgaggcggctgaggcgatggccgagggcgtgagccgggcgtgtccatccgcccagttggcgcttgtccccatcgcggacggcggcgaaggcacgcttgcggccatcgccacctcgacccgcgcgcggtggctatcgaccgaggttacggcggcgagcggccaacctaagcaaggccgtttccttgccctccccgatggcaccgccgtcgtcgagtgcgcggaggccgtcggcctgccggaggccctccgttcgggcgcggacgtctggcgccggaccacggtcggggtcggcgagatgatccggcacgcgctcgagacggggcatcgccgcatcgcggtggcgctcgggggatccgccacgaacgacgcgggcgtcggcatgctcgcggcgctcggtgtgcgattactcgatgatgcgggccaggacgtgcccccggtgccggcggagtttcaccgcgtggcgcgcgtcgacgtgtctggcctcgacgagcgcctccgcggcgccgagatgctcgccgtgtgcgacgtggataacccgctcacgggcgaaaacggggccaccaccgtcttcggcccgcagaagggcgtctcgacccacgacgtgccgcgtctagacgaggcgctcgcgcacctggccgcgcgctgcgaggcggcctttggctgcaaagcggcggacctgcccggcgcaggcgcggcggggggccttggcttcgcgctctaccttcttggcgccgcgcgggtgtccggcatcgactttgtgctggacgcggtcgggttcgatcacgcccttgaacgtgccgcgctcgtcctcaccggcgaaggcaaaacggatgcgcagacggcccacggcaaggcggtggctggcgtggcccggcgcgccaaagcccgcggcgtgcctgtgttctgcatctccggggccatcggcccgggggccgagcgcctgtacgatcacggcgtctccgcgctcttcgccaccgcgcccgggcccatcgcgctggacgaggccatggcgaacgccaaggcgctgcttgcggctgctgcggaaaacgccgtgcgtgcgtggctcgctggacggccttag

SEQ ID NO: 746 - DNA, 1170 bp, Artificial
  Substituion in SEQ ID NO 733
gtgacgcacgtgacatccatcggcgcgaaaggtgaagctccccacatcctgctcgcccccgattccttcaagggctcgctcaccgcgcgcgaggcggctgaggcgatggccgagggcgtgagccgggcgtgtccatccgcccagttggcgcttgtccccatcgcggacggcggcgaaggcacgcttgcggccatcgccacctcgacccgcgcgcggtggctatcgaccgaggttacggcggcgagcggccaacctaagcaaggccgtttccttgccctccccgatggcaccgccgtcgtcgagtgcgcggaggccgtcggcctgccggaggccctccgttcgggcgcggacgtctggcgccggaccacggtcggggtcggcgagatgatccggcacgcgctcgagacggggcatcgccgcatcgcggtggcgctcgggggatccgccacgaacgacgcgggcgtcggcatgctcgcggcgctcggtgtgcgattactcgatgatgcgggccaggacgtgcccccggtgccggcggagtttcaccgcgtggcgcgcgtcgacgtgtctggcctcgacgagcgcctccgcggcgccgagatgctcgccgtgtgcgacgtggataacccgctcacgggcgaaaacggggccaccaccgtcttcggcccgcagaagggcgtctcgacccacgacgtgccgcgtctagacgaggcgctcgcgcacctggccgcgcgctgcgaggcggcctttggctgcaaagcggcggacctgcccggcgcaggcgcggcggggggccttggcttcgcgctctaccttcttggcgccgcgcgggtgtccggcatcgactttgtgctggacgcggtcgggttcgatcacgcccttgaacgtgccgcgctcgtcctcaccggcgaaggccgcacggatgcgcagacggcccacggcaaggcggtggctggcgtggcccggcgcgccaaagcccgcggcgtgcctgtgttctgcatctccggggccatcggcccgggggccgagcgcctgtacgatcacggcgtctccgcgctcttcgccaccgcgcccgggcccatcgcgctggacgaggccatggcgaacgccaaggcgctgcttgcggctgctgcggaacaagccgtgcgtgcgtggctcgctggacggccttag

SEQ ID NO: 747 - DNA, 1170 bp, Artificial
  Substituion in SEQ ID NO 733
gtgacgcacgtgacatccatcggcgcgaaaggtgaagctccccacatcctgctcgcccccgattccttcaagggctcgctcaccgcgcgcgaggcggctgaggcgatggccgagggcgtgagccgggcgtgtccatccgcccagttggcgcttgtccccatcgcggacggcggcgaaggcacgcttgcggccatcgccacctcgacccgcgcgcggtggctatcgaccgaggttacggcggcgagcggccaacctaagcaaggccgtttccttgccctccccgatggcaccgccgtcgtcgagtgcgcggaggccgtcggcctgccggaggccctccgttcgggcgcggacgtctggcgccggaccacggtcggggtcggcgagatgatccggcacgcgctcgagacggggcatcgccgcatcgcggtggcgctcgggggatccgccacgaacgacgcgggcgtcggcatgctcgcggcgctcggtgtgcgattactcgatgatgcgggccaggacgtgcccccggtgccggcggagtttcaccgcgtggcgcgcgtcgacgtgtctggcctcgacgagcgcctccgcggcgccgagatgctcgccgtgtgcgacgtggaaaacccgctcacgggcgaaaacggggccaccaccgtcttcggcccgcagaagggcgtctcgacccacgacgtgccgcgtctagacgaggcgctcgcgcacctggccgcgcgctgcgaggcggcctttggctgcaaagcggcggacctgcccggcgcaggcgcggcggggggccttggcttcgcgctctaccttcttggcgccgcgcgggtgtccggcatcgactttgtgctggacgcggtcgggttcgatcacgcccttgaacgtgccgcgctcgtcctcaccggcgaaggccgcacggatgcgcagacggcccacggcaaggcggtggctggcgtggcccggcgcgccaaagcccgcggcgtgcctgtgttctgcatctccggggccatcggcccgggggccgagcgcctgtacgatcacggcgtctccgcgctcttcgccaccgcgcccgggcccatcgcgctggacgaggccatggcgaacgccaaggcgctgcttgcggctgctgcggaaaacgccgtgcgtgcgtggctcgctggacggccttag

SEQ ID NO: 748 - DNA, 1170 bp, Artificial
  Substituion in SEQ ID NO 733
gtgacgcacgtgacatccatcggcgcgaaaggtgaagctccccacatcctgctcgcccccgattccttcaagggctcgctcaccgcgcgcgaggcggctgaggcgatggccgagggcgtgagccgggcgtgtccatccgcccagttggcgcttgtccccatcgcggacggcggcgaaggcacgcttgcggccatcgccacctcgacccgcgcgcggtggctatcgaccgaggttacggcggcgagcggccaacctaagcaaggccgtttccttgccctccccgatggcaccgccgtcgtcgagtgcgcggaggccattggcctgccggaggccctccgttcgggcgcggacgtctggcgccggaccacggtcggggtcggcgagatgatccggcacgcgctcgagacggggcatcgccgcatcgcggtggcgctcgggggatccgccacgaacgacgcgggcgtcggcatgctcgcggcgctcggtgtgcgattactcgatgatgcgggccaggacgtgcccccggtgccggcggagtttcaccgcgtggcgcgcgtcgacgtgtctggcctcgacgagcgcctccgcggcgccgagatgctcgccgtgtgcgacgtggataacccgctcacgggcgaaaacggggccaccaccgtcttcggcccgcagaagggcgtctcgacccacgacgtgccgcgtctagacgaggcgctcgcgcacctggccgcgcgctgcgaggcggcctttggctgcaaagcggcggacctgcccggcgcaggcgcggcggggggccttggcttcgcgctctaccttcttggcgccgcgcgggtgtccggcatcgactttgtgctggacgcggtcgggttcgatcacgcccttgaacgtgccgcgctcgtcctcaccggcgaaggccgcacggatgcgcagacggcccacggcaaggcggtggctggcgtggcccggcgcgccaaagcccgcggcgtgcctgtgttctgcatctccggggccatcggcccgggggccgagcgcctgtacgatcacggcgtctccgcgctcttcgccaccgcgcccgggcccatcgcgctggacgaggccatggcgaacgccaaggcgctgcttgcggctgctgcggaaaacgccgtgcgtgcgtggctcgctggacggccttag

SEQ ID NO: 749 - protein, 148 aa, Alicyclobacillus acidocaldarius
MLTVPLEIVTPERIVLSMDVRMVILRGGDGEIGILPRHMPLATAVKPCLVRIRLADDRQDVVPVSGGFVEVLPEKITILADTAELPEEIDVDRALRAKDRAEKRLQAAVDEEEADRARQALTRAELRLQAVEEHKRLNGFLHASVPSA

SEQ ID NO: 750 - DNA, 447 bp, Alicyclobacillus acidocaldarius
atgttgaccgtgccgctcgaaatcgtcacgccggagcggatcgtgctgtcgatggacgtgcgcatggtgatcctgcggggcggcgatggcgaaatcggcatcttgccacgccacatgccgctcgctacggcggtgaagccgtgcctggtgcgcattcggctggcggacgatcgccaggacgtggtaccggtgtcaggcgggttcgtcgaggtcctgcctgagaagatcaccatcctcgcggacaccgcggagttgcctgaggaaatcgacgtcgatcgcgcccttcgcgccaaggaccgcgcggagaagcggctgcaggccgcggtcgacgaggaagaagcggatcgcgcgcgtcaggcgctcacgcgcgctgaactgcggctgcaggcggtggaagagcacaaacgcctgaacggatttctgcacgcaagtgtcccgagcgcttaa

SEQ ID NO: 751 - protein, 133 aa, Thermosinus carboxydivorans Nor1
TVRLDIVTPERLAYSDDVNMVIARATDGDIGILPGHAPLIAGLEIAPLRILKDDGEKRIAVCGGFIEVRPDKVTVLAGCAELPEEIDVKRAEAARERAEARLKYREGIDVARAEQALKRALMRLSVAEYHKKM

SEQ ID NO: 752 - protein, 129 aa, Bacillus sp. TA2.A1
MATVQVDIVTPERKVFQGEADIVIARGVEGELGVMAGHIPLVTPLKTAPVRIKQGDKETLIAVSGGFLEVRPDKVNILADTAELPEEIDVERAKKAKARHETILKRLDKTDKDYLRHKRALERAEVRLQ

SEQ ID NO: 753 - protein, 104 aa, Bacillus pseudofirmus
MSTIRVNVVTPDGKVYDGDVDMVVVRTVEGELGILPKHIPLVAPLTVGAVRLKKGNSEEQVAVSGGFVEVRPDQVTILAEAAELPSAIDVDRARAAKERAESRL

SEQ ID NO: 754 - protein, 127 aa, Halothermothrix orenii H 168
TIRLEVVTPEKVVFSEPVNILIAPAIDGEIGILPKHTPLVTGLKTGVMRVKKDGEEVKISISEGFMEVKPDEINVIVRTAELPHEIDVERARDALKRAEKRLNSRNDRIDRARARAAFERAIARLKA

SEQ ID NO: 755 - protein, 102 aa, Desulfitobacterium hafniense Y51
TFTLRVVSPEGNVLKEEAEFVVLPGGNGEIGILPNHAPLISSIEIGVIRYTVNGKVEKIATSGGFVEVSDNKVTILADTAEPGEKVDLDRALAAKERAEKRL

SEQ ID NO: 756 - protein, 148 aa, Artificial
  Substituion in SEQ ID NO 749
MLTVPLEIVTPERIVLSMDVRMVILRGGDGEIGILPRHMPLATAVKPCLVRLRLADDRQDVVPVSGGFVEVLPEKITILADTAELPEEIDVDRALRAKDRAEKRLQAAVDEEEADRARQALTRAELRLQAVEEHKRLNGFLHASVPSA

SEQ ID NO: 757 - protein, 148 aa, Artificial
  Substituion in SEQ ID NO 749
MLTVPLEIVTPERIVLSMDVRMVILRGGDGEIGILPRHMPLATAVKPCLVRIRLADDRQDVVPVSGGFVEVLPEKITILADTAELPEEIDVDRALRAKDRAERRLQAAVDEEEADRARQALTRAELRLQAVEEHKRLNGFLHASVPSA

SEQ ID NO: 758 - protein, 148 aa, Artificial
  Substituion in SEQ ID NO 749
MLTVPLEIVTPERIVLSMDVRMVILRGGDGEIGILPRHMPLATAVKPCLVRIRLADDRQDVVPVSGGFVEVLPEKITILADTAELPEEIDVDRALRAKDRAEKRLQAAVDEEEADRARQALTRAELRLQAVEEHKRINGFLHASVPSA

SEQ ID NO: 759 - protein, 148 aa, Artificial
  Substituion in SEQ ID NO 749
MLTVPLEIVTPERIVLSMDVRMVILRGGDGEIGILPRHMPLATAVKPCLVRIRLADDRQDVVPVSGGFVEVLPEKITILADTAELPEEIDVDRALRAKDRAEKRIQAAVDEEEADRARQALTRAELRLQAVEEHKRLNGFLHASVPSA

SEQ ID NO: 760 - protein, 148 aa, Artificial
  Substituion in SEQ ID NO 749
MLTVPLEIVTPERIVLSMDVRMVILRGGDGEIGILPRHMPLATAVKPCLVRIRLADERQDVVPVSGGFVEVLPEKITILADTAELPEEIDVDRALRAKDRAEKRLQAAVDEEEADRARQALTRAELRLQAVEEHKRLNGFLHASVPSA

SEQ ID NO: 761 - DNA, 447 bp, Artificial
  Substituion in SEQ ID NO 750
atgttgaccgtgccgctcgaaatcgtcacgccggagcggatcgtgctgtcgatggacgtgcgcatggtgatcctgcggggcggcgatggcgaaatcggcatcttgccacgccacatgccgctcgctacggcggtgaagccgtgcctggtgcgcttacggctggcggacgatcgccaggacgtggtaccggtgtcaggcgggttcgtcgaggtcctgcctgagaagatcaccatcctcgcggacaccgcggagttgcctgaggaaatcgacgtcgatcgcgcccttcgcgccaaggaccgcgcggagaagcggctgcaggccgcggtcgacgaggaagaagcggatcgcgcgcgtcaggcgctcacgcgcgctgaactgcggctgcaggcggtggaagagcacaaacgcctgaacggatttctgcacgcaagtgtcccgagcgcttaa

SEQ ID NO: 762 - DNA, 447 bp, Artificial
  Substituion in SEQ ID NO 750
atgttgaccgtgccgctcgaaatcgtcacgccggagcggatcgtgctgtcgatggacgtgcgcatggtgatcctgcggggcggcgatggcgaaatcggcatcttgccacgccacatgccgctcgctacggcggtgaagccgtgcctggtgcgcattcggctggcggacgatcgccaggacgtggtaccggtgtcaggcgggttcgtcgaggtcctgcctgagaagatcaccatcctcgcggacaccgcggagttgcctgaggaaatcgacgtcgatcgcgcccttcgcgccaaggaccgcgcggagcgtcggctgcaggccgcggtcgacgaggaagaagcggatcgcgcgcgtcaggcgctcacgcgcgctgaactgcggctgcaggcggtggaagagcacaaacgcctgaacggatttctgcacgcaagtgtcccgagcgcttaa

SEQ ID NO: 763 - DNA, 447 bp, Artificial
  Substituion in SEQ ID NO 750
atgttgaccgtgccgctcgaaatcgtcacgccggagcggatcgtgctgtcgatggacgtgcgcatggtgatcctgcggggcggcgatggcgaaatcggcatcttgccacgccacatgccgctcgctacggcggtgaagccgtgcctggtgcgcattcggctggcggacgatcgccaggacgtggtaccggtgtcaggcgggttcgtcgaggtcctgcctgagaagatcaccatcctcgcggacaccgcggagttgcctgaggaaatcgacgtcgatcgcgcccttcgcgccaaggaccgcgcggagaagcggctgcaggccgcggtcgacgaggaagaagcggatcgcgcgcgtcaggcgctcacgcgcgctgaactgcggctgcaggcggtggaagagcacaaacgcattaacggatttctgcacgcaagtgtcccgagcgcttaa

SEQ ID NO: 764 - DNA, 447 bp, Artificial
  Substituion in SEQ ID NO 750
atgttgaccgtgccgctcgaaatcgtcacgccggagcggatcgtgctgtcgatggacgtgcgcatggtgatcctgcggggcggcgatggcgaaatcggcatcttgccacgccacatgccgctcgctacggcggtgaagccgtgcctggtgcgcattcggctggcggacgatcgccaggacgtggtaccggtgtcaggcgggttcgtcgaggtcctgcctgagaagatcaccatcctcgcggacaccgcggagttgcctgaggaaatcgacgtcgatcgcgcccttcgcgccaaggaccgcgcggagaagcggattcaggccgcggtcgacgaggaagaagcggatcgcgcgcgtcaggcgctcacgcgcgctgaactgcggctgcaggcggtggaagagcacaaacgcctgaacggatttctgcacgcaagtgtcccgagcgcttaa

SEQ ID NO: 765 - DNA, 447 bp, Artificial
  Substituion in SEQ ID NO 750
atgttgaccgtgccgctcgaaatcgtcacgccggagcggatcgtgctgtcgatggacgtgcgcatggtgatcctgcggggcggcgatggcgaaatcggcatcttgccacgccacatgccgctcgctacggcggtgaagccgtgcctggtgcgcattcggctggcggacgaacgccaggacgtggtaccggtgtcaggcgggttcgtcgaggtcctgcctgagaagatcaccatcctcgcggacaccgcggagttgcctgaggaaatcgacgtcgatcgcgcccttcgcgccaaggaccgcgcggagaagcggctgcaggccgcggtcgacgaggaagaagcggatcgcgcgcgtcaggcgctcacgcgcgctgaactgcggctgcaggcggtggaagagcacaaacgcctgaacggatttctgcacgcaagtgtcccgagcgcttaa

SEQ ID NO: 766 - protein, 497 aa, Alicyclobacillus acidocaldarius
MFWLLPRYAPGLTQFAVAHVDGARIYLCLNLYSGPVHRSCRRASCKRETIGVDGVKSEHLLDVRPRVDAHFPRDEKGHLLIGGVSAVDLVAQFGTPLIAYDEGLIRDTIRAFHRVFQDEGVPYQISYASKAFCTMAICQLAHEEGLGIDVVSGGELYTALAAGVPASKLHMHGNNKTPEELEYAIESGIGAVIVDNFDEIDLLADILQETGRTVDVLVRVAPGVEAHTHDYISTGQQDSKFGFDLASHQVEEAFSRLKEVERARVIGVHAHIGSQIFDVEGFRLLADRMAGVYEDGLRRFGLPFSVLNLGGGFGIPYTDEDAPPVADLVRGVIRAAKAAFAARGMDVPVLWIEPGRSIVGPAGVTLYRVGSRKVIPGVRNYVAIDGGMTDNPRLALYGAKYHACYANRAADPPDRPWSVAGKCCESGDMLIWDLPLPDPQPGDLLAVFATGAYTYAMASHYNRIPKPAVVFCRDGEARLVARRETWADVARLDVPLR

SEQ ID NO: 767 - DNA, 1494 bp, Alicyclobacillus acidocaldarius
gtgttctggcttttaccgcgctatgcaccgggcttaacgcaatttgccgttgcccacgtcgatggcgcacgtatatacttgtgtctgaatctttattcaggtcctgtacacaggtcgtgtcgccgcgcgtcatgcaagagagagacgataggagtggacggagtgaaatcagagcacctgttggacgtgaggccgagggtggacgcgcattttccgcgagacgaaaagggtcatcttctcatcggcggggtgagcgcggtcgatctcgtggcacagttcggcacgccgctcatcgcgtacgacgaggggctgattcgcgataccatccgcgcgtttcaccgcgtgtttcaagacgaaggcgtgccctatcagatttcttacgccagcaaggccttctgcaccatggccatctgccaactcgcgcacgaggagggcttgggcatcgacgtggtgtccggcggcgagttgtacaccgcgctcgcggccggcgtgccggcgagcaagctccacatgcatggcaacaacaaaacgccggaggaactcgaatacgccattgagagcggcatcggggccgtgatcgtggacaatttcgacgagatcgatctcctggccgatatccttcaagaaaccgggcgcacggtcgatgtcctggtgcgggtggcgccaggtgtcgaggcgcacacgcacgactacatctccaccgggcagcaggactccaagtttggcttcgatctcgccagccaccaggtggaggaggccttttcgcggctcaaagaggtggaacgcgcgcgggtcatcggcgtgcatgcgcacatcggatcgcagatcttcgatgtggagggctttcgactgctcgccgatcgaatggcgggcgtgtacgaagacggcctgcgccggttcggcctgcccttttccgtgctcaacctgggtggcgggtttggcatcccgtacacggatgaggatgcgccgccggtggccgatctcgtccggggtgtgatccgcgccgccaaggcggcctttgcggcgcgaggcatggacgtgccggtgctctggattgaacccggccgaagcatcgtcgggcccgcgggcgtgacgctgtaccgcgtgggcagtcgcaaggtcattccgggcgtgcggaattacgtcgccatcgacgggggcatgacggacaacccgcgcctggcgctctatggcgcgaagtaccacgcgtgttacgcaaatcgggcggcggatccgccggatcgcccgtggtcggtggcgggcaagtgctgcgagagcggggacatgctcatctgggatctcccgcttccggatccgcagccgggggatctcctcgccgtcttcgcgaccggcgcgtacacgtatgcgatggcgagccactacaaccgcattcccaagcccgccgtcgtgttttgccgcgatggcgaggcgcgcctcgtggcgcggcgcgagacgtgggcggacgtggcgcggctcgatgtgccgcttcggtga

SEQ ID NO: 768 - protein, 426 aa, Bacillus licheniformis ATCC 14580
QNERGHLEIGGVDVLSLAERYGTPLYVYDVALIRERARKFQKAFKEAGLKAQVAYASKAFSSVAMIQLAEQEGLSLDVVSGGELFTAIKAGFPAERIHFHGNNKSPEELAMALEHQIGCIVLDNFHEIAITEDLCKRSGQTVDVLLRITPGVEAHTHDYITTGQEDSKFGFDLHNGQVEQAIEQVLRSSAFKLLGVHCHIGSQIFDTAGFVLAADKIFEKLAEWRETYSFIPEVLNLGGGFGIRYTKDDEPLAADVYVEKIIEAVKANAEHFGFDIPEIWIEPGRSLVGDAGTTLYTIGSQKEVPGIRKYVAIDGGMSDNIRPALYEAKYEAAVANRMNDACHDTASIAGKCCESGDMLIWDLEIPEVRDGDVLAVFCTGAYGYSMANNYNRIPRPAVVFVEDGEAQLVIQRETYEDIVKLDLPLK

SEQ ID NO: 769 - protein, 426 aa, Bacillus subtilis
QNQHGHLEIGGVDALYLAEKYGTPLYVYDVALIRERAKSFKQAFISAGLKAQVAYASKAFSSVAMIQLAEEEGLSLDVVSGGELYTAVAAGFPAERIHFHGNNKSREELRMALEHRIGCIVVDNFYEIALLEDLCKETGHSIDVLLRITPGVEAHTHDYITTGQEDSKFGFDLHNGQTERAIEQVLQSEHIQLLGVHCHIGSQIFDTAGFVLAAEKIFKKLDEWRDSYSFVSKVLNLGGGFGIRYTEDDEPLHATEYVEKIIEAVKENASRYGFDIPEIWIEPGRSLVGDAGTTLYTVGSQKEVPGVRQYVAVDGGMNDNIRPALYQAKYEAAAANRIGEAHDKTVSIAGKCCESGDMLIWDIDLPEVKEGDLLAVFCTGAYGYSMANNYNRIPRPAVVFVENGEAHLVVKRETYEDIVKLDLPFK

SEQ ID NO: 770 - protein, 426 aa, Bacillus subtilis subsp. subtilis str. 168; identical to SEQ ID NO: 769

SEQ ID NO: 771 - protein, 426 aa, Bacillus amyloliquefaciens FZB42
QNKLGHLEIGGVDALYLAEHYGTPLYVYDVALIRERAKSFKQAFIDADLKAQVAYASKAFSSVAMIQLAEQEGLSLDVVSGGELFTAVAAGFPADRIHFHGNNKSEEELKMALDHQIGCIVVDNFYEISLLAELCRKSGRTMDVLLRITPGVEAHTHDYITTGQEDSKFGFDLHNGQIEKAIEQVLQSDHIRLLGVHCHIGSQIFDTAGFVLAAEKIFAKLNEWRESFGFVSEVLNLGGGFGIRYTEEDEPLHPAVYVEKIIEAVKENAALHAFDIPEIWIEPGRSLVGDAGTTLYTIGSQKEVPGTRKYAAVDGGMSDNIRPALYQAKYEAVSANRIGEHHDKTVSIAGKCCESGDMLIWDIDLPEVKEGDLLAVFCTGAYGYSMANNYNRIPRPAVVFVEDGEAHLVIRRETYEDIVKLDLPFK

SEQ ID NO: 772 - protein, 424 aa, Bacillus pumilus SAFR-032
QNELGHLEIGGVDAVSLAETYGTPLYVYDVALIRERAKSFQKAFIEEELTAQVAYASKAFSSIAMFQLAKEEGLSLDVVSGGELHTAICAGFPVEKIHFHGNNKSRDELKMALENEIGCIVVDNFYEMKLLEELGQELSKQVKVLLRITPGVEAHTHDYITTGQEDSKFGFDLHNGQADEAVKRVLESEVIELLGVHCHIGSQIFDTAGFVLAADKIFLKLNEWRESFGFISTVLNLGGGFGIRYTEEDEPLPATEYVEKIIQAVKENVARYEFDMPEIWIEPGRSLVGDAGTTLYTIGSSKHVPGIRDYVAVDGGMSDNIRPALYQAKYEAASANKMSQSHDQTVSIAGKCCESGDMLIWDIDLPELSQGDLLAVFCTGAYGYSMSNNYNRIPRPAVVFVEDGEAQLVVERESYADMVKLDLP

SEQ ID NO: 773 - protein, 497 aa, Artificial
  Substituion in SEQ ID NO 766
MFWLLPRYAPGLTQFAVAHVDGARIYLCLNLYSGPVHRSCRRASCKRETIGVDGVKSEHLLDVRPRVDAHFPRDEKGHLLIGGVSAVELVAQFGTPLIAYDEGLIRDTIRAFHRVFQDEGVPYQISYASKAFCTMAICQLAHEEGLGIDVVSGGELYTALAAGVPASKLHMHGNNKTPEELEYAIESGIGAVIVDNFDEIDLLADILQETGRTVDVLVRVAPGVEAHTHDYISTGQQDSKFGFDLASHQVEEAFSRLKEVERARVIGVHAHIGSQIFDVEGFRLLADRMAGVYEDGLRRFGLPFSVLNLGGGFGIPYTDEDAPPVADLVRGVIRAAKAAFAARGMDVPVLWIEPGRSIVGPAGVTLYRVGSRKVIPGVRNYVAIDGGMTDNPRLALYGAKYHACYANRAADPPDRPWSVAGKCCESGDMLIWDLPLPDPQPGDLLAVFATGAYTYAMASHYNRIPKPAVVFCRDGEARLVARRETWADVARLDVPLR

SEQ ID NO: 774 - protein, 497 aa, Artificial
  Substituion in SEQ ID NO 766
MFWLLPRYAPGLTQFAVAHVDGARIYLCLNLYSGPVHRSCRRASCKKETIGVDGVKSEHLLDVRPRVDAHFPRDEKGHLLIGGVSAVDLVAQFGTPLIAYDEGLIRDTIRAFHRVFQDEGVPYQISYASKAFCTMAICQLAHEEGLGIDVVSGGELYTALAAGVPASKLHMHGNNKTPEELEYAIESGIGAVIVDNFDEIDLLADILQETGRTVDVLVRVAPGVEAHTHDYISTGQQDSKFGFDLASHQVEEAFSRLKEVERARVIGVHAHIGSQIFDVEGFRLLADRMAGVYEDGLRRFGLPFSVLNLGGGFGIPYTDEDAPPVADLVRGVIRAAKAAFAARGMDVPVLWIEPGRSIVGPAGVTLYRVGSRKVIPGVRNYVAIDGGMTDNPRLALYGAKYHACYANRAADPPDRPWSVAGKCCESGDMLIWDLPLPDPQPGDLLAVFATGAYTYAMASHYNRIPKPAVVFCRDGEARLVARRETWADVARLDVPLR

SEQ ID NO: 775 - protein, 497 aa, Artificial
  Substituion in SEQ ID NO 766
MFWLLPRYAPGLTQFAVAHVDGARIYLCLNLYSGPVHRSCRRASCKRETIGVDGVKSEHLLDVRPRVDAHFPRDEKGHLLIGGVSAVDLVAQFGTPLIAYDEGLIRDTIRAFHRVFQDEGVPYQISYASKAFCTMAICQLAHEEGLGIDVVSGGELYTALAAGVPASKLHMHGNNKTPEELEYAIESGIGAVIVDNFDEIDLLADILQETGRTVDVLVRVAPGVEAHTHDYISTGQQDSKFGFDLASHQVEEAFSRLKEVERARVIGVHAHIGSQIFDVEGFRLLADRMAGVYEDGLRRFGLPFSVLNLGGGFGIPYTDEDAPPVADLVRGVIRAAKAAFAAKGMDVPVLWIEPGRSIVGPAGVTLYRVGSRKVIPGVRNYVAIDGGMTDNPRLALYGAKYHACYANRAADPPDRPWSVAGKCCESGDMLIWDLPLPDPQPGDLLAVFATGAYTYAMASHYNRIPKPAVVFCRDGEARLVARRETWADVARLDVPLR

SEQ ID NO: 776 - protein, 497 aa, Artificial
  Substituion in SEQ ID NO 766
MFWLLPRYAPGLTQFAVAHVDGAKIYLCLNLYSGPVHRSCRRASCKRETIGVDGVKSEHLLDVRPRVDAHFPRDEKGHLLIGGVSAVDLVAQFGTPLIAYDEGLIRDTIRAFHRVFQDEGVPYQISYASKAFCTMAICQLAHEEGLGIDVVSGGELYTALAAGVPASKLHMHGNNKTPEELEYAIESGIGAVIVDNFDEIDLLADILQETGRTVDVLVRVAPGVEAHTHDYISTGQQDSKFGFDLASHQVEEAFSRLKEVERARVIGVHAHIGSQIFDVEGFRLLADRMAGVYEDGLRRFGLPFSVLNLGGGFGIPYTDEDAPPVADLVRGVIRAAKAAFAARGMDVPVLWIEPGRSIVGPAGVTLYRVGSRKVIPGVRNYVAIDGGMTDNPRLALYGAKYHACYANRAADPPDRPWSVAGKCCESGDMLIWDLPLPDPQPGDLLAVFATGAYTYAMASHYNRIPKPAVVFCRDGEARLVARRETWADVARLDVPLR

SEQ ID NO: 777 - protein, 497 aa, Artificial
  Substituion in SEQ ID NO 766
MFWLLPRYAPGLTQFAVAHVDGARIYLCLNLYSGPVHRSCRRASCKRETIGVDGVKSEHLLDVRPRVDAHFPRDEKGHLLIGGVSAVDLVAQFGTPLIAYDEGLIRDTIRAFHRVFQDEGVPYQISYASKAFCTMAICQLAHEEGLGIDVVSGGELYTALAAGVPASKLHMHGNNKTPEELEYAIESGIGAVIVDNFDEIDLLADILQETGRTVDVLVRVAPGVEAHTHDYISTGQQDSKFGFDLASHQVEEAFSRLKEIERARVIGVHAHIGSQIFDVEGFRLLADRMAGVYEDGLRRFGLPFSVLNLGGGFGIPYTDEDAPPVADLVRGVIRAAKAAFAARGMDVPVLWIEPGRSIVGPAGVTLYRVGSRKVIPGVRNYVAIDGGMTDNPRLALYGAKYHACYANRAADPPDRPWSVAGKCCESGDMLIWDLPLPDPQPGDLLAVFATGAYTYAMASHYNRIPKPAVVFCRDGEARLVARRETWADVARLDVPLR

SEQ ID NO: 778 - DNA, 1494 bp, Artificial
  Substituion in SEQ ID NO 767
gtgttctggcttttaccgcgctatgcaccgggcttaacgcaatttgccgttgcccacgtcgatggcgcacgtatatacttgtgtctgaatctttattcaggtcctgtacacaggtcgtgtcgccgcgcgtcatgcaagagagagacgataggagtggacggagtgaaatcagagcacctgttggacgtgaggccgagggtggacgcgcattttccgcgagacgaaaagggtcatcttctcatcggcggggtgagcgcggtcgaactcgtggcacagttcggcacgccgctcatcgcgtacgacgaggggctgattcgcgataccatccgcgcgtttcaccgcgtgtttcaagacgaaggcgtgccctatcagatttcttacgccagcaaggccttctgcaccatggccatctgccaactcgcgcacgaggagggcttgggcatcgacgtggtgtccggcggcgagttgtacaccgcgctcgcggccggcgtgccggcgagcaagctccacatgcatggcaacaacaaaacgccggaggaactcgaatacgccattgagagcggcatcggggccgtgatcgtggacaatttcgacgagatcgatctcctggccgatatccttcaagaaaccgggcgcacggtcgatgtcctggtgcgggtggcgccaggtgtcgaggcgcacacgcacgactacatctccaccgggcagcaggactccaagtttggcttcgatctcgccagccaccaggtggaggaggccttttcgcggctcaaagaggtggaacgcgcgcgggtcatcggcgtgcatgcgcacatcggatcgcagatcttcgatgtggagggctttcgactgctcgccgatcgaatggcgggcgtgtacgaagacggcctgcgccggttcggcctgcccttttccgtgctcaacctgggtggcgggtttggcatcccgtacacggatgaggatgcgccgccggtggccgatctcgtccggggtgtgatccgcgccgccaaggcggcctttgcggcgcgaggcatggacgtgccggtgctctggattgaacccggccgaagcatcgtcgggcccgcgggcgtgacgctgtaccgcgtgggcagtcgcaaggtcattccgggcgtgcggaattacgtcgccatcgacgggggcatgacggacaacccgcgcctggcgctctatggcgcgaagtaccacgcgtgttacgcaaatcgggcggcggatccgccggatcgcccgtggtcggtggcgggcaagtgctgcgagagcggggacatgctcatctgggatctcccgcttccggatccgcagccgggggatctcctcgccgtcttcgcgaccggcgcgtacacgtatgcgatggcgagccactacaaccgcattcccaagcccgccgtcgtgttttgccgcgatggcgaggcgcgcctcgtggcgcggcgcgagacgtgggcggacgtggcgcggctcgatgtgccgcttcggtga

SEQ ID NO: 779 - DNA, 1494 bp, Artificial
  Substituion in SEQ ID NO 767
gtgttctggcttttaccgcgctatgcaccgggcttaacgcaatttgccgttgcccacgtcgatggcgcacgtatatacttgtgtctgaatctttattcaggtcctgtacacaggtcgtgtcgccgcgcgtcatgcaagaaagagacgataggagtggacggagtgaaatcagagcacctgttggacgtgaggccgagggtggacgcgcattttccgcgagacgaaaagggtcatcttctcatcggcggggtgagcgcggtcgatctcgtggcacagttcggcacgccgctcatcgcgtacgacgaggggctgattcgcgataccatccgcgcgtttcaccgcgtgtttcaagacgaaggcgtgccctatcagatttcttacgccagcaaggccttctgcaccatggccatctgccaactcgcgcacgaggagggcttgggcatcgacgtggtgtccggcggcgagttgtacaccgcgctcgcggccggcgtgccggcgagcaagctccacatgcatggcaacaacaaaacgccggaggaactcgaatacgccattgagagcggcatcggggccgtgatcgtggacaatttcgacgagatcgatctcctggccgatatccttcaagaaaccgggcgcacggtcgatgtcctggtgcgggtggcgccaggtgtcgaggcgcacacgcacgactacatctccaccgggcagcaggactccaagtttggcttcgatctcgccagccaccaggtggaggaggccttttcgcggctcaaagaggtggaacgcgcgcgggtcatcggcgtgcatgcgcacatcggatcgcagatcttcgatgtggagggctttcgactgctcgccgatcgaatggcgggcgtgtacgaagacggcctgcgccggttcggcctgcccttttccgtgctcaacctgggtggcgggtttggcatcccgtacacggatgaggatgcgccgccggtggccgatctcgtccggggtgtgatccgcgccgccaaggcggcctttgcggcgcgaggcatggacgtgccggtgctctggattgaacccggccgaagcatcgtcgggcccgcgggcgtgacgctgtaccgcgtgggcagtcgcaaggtcattccgggcgtgcggaattacgtcgccatcgacgggggcatgacggacaacccgcgcctggcgctctatggcgcgaagtaccacgcgtgttacgcaaatcgggcggcggatccgccggatcgcccgtggtcggtggcgggcaagtgctgcgagagcggggacatgctcatctgggatctcccgcttccggatccgcagccgggggatctcctcgccgtcttcgcgaccggcgcgtacacgtatgcgatggcgagccactacaaccgcattcccaagcccgccgtcgtgttttgccgcgatggcgaggcgcgcctcgtggcgcggcgcgagacgtgggcggacgtggcgcggctcgatgtgccgcttcggtga

SEQ ID NO: 780 - DNA, 1494 bp, Artificial
  Substituion in SEQ ID NO 767
gtgttctggcttttaccgcgctatgcaccgggcttaacgcaatttgccgttgcccacgtcgatggcgcacgtatatacttgtgtctgaatctttattcaggtcctgtacacaggtcgtgtcgccgcgcgtcatgcaagagagagacgataggagtggacggagtgaaatcagagcacctgttggacgtgaggccgagggtggacgcgcattttccgcgagacgaaaagggtcatcttctcatcggcggggtgagcgcggtcgatctcgtggcacagttcggcacgccgctcatcgcgtacgacgaggggctgattcgcgataccatccgcgcgtttcaccgcgtgtttcaagacgaaggcgtgccctatcagatttcttacgccagcaaggccttctgcaccatggccatctgccaactcgcgcacgaggagggcttgggcatcgacgtggtgtccggcggcgagttgtacaccgcgctcgcggccggcgtgccggcgagcaagctccacatgcatggcaacaacaaaacgccggaggaactcgaatacgccattgagagcggcatcggggccgtgatcgtggacaatttcgacgagatcgatctcctggccgatatccttcaagaaaccgggcgcacggtcgatgtcctggtgcgggtggcgccaggtgtcgaggcgcacacgcacgactacatctccaccgggcagcaggactccaagtttggcttcgatctcgccagccaccaggtggaggaggccttttcgcggctcaaagaggtggaacgcgcgcgggtcatcggcgtgcatgcgcacatcggatcgcagatcttcgatgtggagggctttcgactgctcgccgatcgaatggcgggcgtgtacgaagacggcctgcgccggttcggcctgcccttttccgtgctcaacctgggtggcgggtttggcatcccgtacacggatgaggatgcgccgccggtggccgatctcgtccggggtgtgatccgcgccgccaaggcggcctttgcggcgaaaggcatggacgtgccggtgctctggattgaacccggccgaagcatcgtcgggcccgcgggcgtgacgctgtaccgcgtgggcagtcgcaaggtcattccgggcgtgcggaattacgtcgccatcgacgggggcatgacggacaacccgcgcctggcgctctatggcgcgaagtaccacgcgtgttacgcaaatcgggcggcggatccgccggatcgcccgtggtcggtggcgggcaagtgctgcgagagcggggacatgctcatctgggatctcccgcttccggatccgcagccgggggatctcctcgccgtcttcgcgaccggcgcgtacacgtatgcgatggcgagccactacaaccgcattcccaagcccgccgtcgtgttttgccgcgatggcgaggcgcgcctcgtggcgcggcgcgagacgtgggcggacgtggcgcggctcgatgtgccgcttcggtga

SEQ ID NO: 781 - DNA, 1494 bp, Artificial
  Substituion in SEQ ID NO 767
gtgttctggcttttaccgcgctatgcaccgggcttaacgcaatttgccgttgcccacgtcgatggcgcaaaaatatacttgtgtctgaatctttattcaggtcctgtacacaggtcgtgtcgccgcgcgtcatgcaagagagagacgataggagtggacggagtgaaatcagagcacctgttggacgtgaggccgagggtggacgcgcattttccgcgagacgaaaagggtcatcttctcatcggcggggtgagcgcggtcgatctcgtggcacagttcggcacgccgctcatcgcgtacgacgaggggctgattcgcgataccatccgcgcgtttcaccgcgtgtttcaagacgaaggcgtgccctatcagatttcttacgccagcaaggccttctgcaccatggccatctgccaactcgcgcacgaggagggcttgggcatcgacgtggtgtccggcggcgagttgtacaccgcgctcgcggccggcgtgccggcgagcaagctccacatgcatggcaacaacaaaacgccggaggaactcgaatacgccattgagagcggcatcggggccgtgatcgtggacaatttcgacgagatcgatctcctggccgatatccttcaagaaaccgggcgcacggtcgatgtcctggtgcgggtggcgccaggtgtcgaggcgcacacgcacgactacatctccaccgggcagcaggactccaagtttggcttcgatctcgccagccaccaggtggaggaggccttttcgcggctcaaagaggtggaacgcgcgcgggtcatcggcgtgcatgcgcacatcggatcgcagatcttcgatgtggagggctttcgactgctcgccgatcgaatggcgggcgtgtacgaagacggcctgcgccggttcggcctgcccttttccgtgctcaacctgggtggcgggtttggcatcccgtacacggatgaggatgcgccgccggtggccgatctcgtccggggtgtgatccgcgccgccaaggcggcctttgcggcgcgaggcatggacgtgccggtgctctggattgaacccggccgaagcatcgtcgggcccgcgggcgtgacgctgtaccgcgtgggcagtcgcaaggtcattccgggcgtgcggaattacgtcgccatcgacgggggcatgacggacaacccgcgcctggcgctctatggcgcgaagtaccacgcgtgttacgcaaatcgggcggcggatccgccggatcgcccgtggtcggtggcgggcaagtgctgcgagagcggggacatgctcatctgggatctcccgcttccggatccgcagccgggggatctcctcgccgtcttcgcgaccggcgcgtacacgtatgcgatggcgagccactacaaccgcattcccaagcccgccgtcgtgttttgccgcgatggcgaggcgcgcctcgtggcgcggcgcgagacgtgggcggacgtggcgcggctcgatgtgccgcttcggtga

SEQ ID NO: 782 - DNA, 1494 bp, Artificial
  Substituion in SEQ ID NO 767
gtgttctggcttttaccgcgctatgcaccgggcttaacgcaatttgccgttgcccacgtcgatggcgcacgtatatacttgtgtctgaatctttattcaggtcctgtacacaggtcgtgtcgccgcgcgtcatgcaagagagagacgataggagtggacggagtgaaatcagagcacctgttggacgtgaggccgagggtggacgcgcattttccgcgagacgaaaagggtcatcttctcatcggcggggtgagcgcggtcgatctcgtggcacagttcggcacgccgctcatcgcgtacgacgaggggctgattcgcgataccatccgcgcgtttcaccgcgtgtttcaagacgaaggcgtgccctatcagatttcttacgccagcaaggccttctgcaccatggccatctgccaactcgcgcacgaggagggcttgggcatcgacgtggtgtccggcggcgagttgtacaccgcgctcgcggccggcgtgccggcgagcaagctccacatgcatggcaacaacaaaacgccggaggaactcgaatacgccattgagagcggcatcggggccgtgatcgtggacaatttcgacgagatcgatctcctggccgatatccttcaagaaaccgggcgcacggtcgatgtcctggtgcgggtggcgccaggtgtcgaggcgcacacgcacgactacatctccaccgggcagcaggactccaagtttggcttcgatctcgccagccaccaggtggaggaggccttttcgcggctcaaagagattgaacgcgcgcgggtcatcggcgtgcatgcgcacatcggatcgcagatcttcgatgtggagggctttcgactgctcgccgatcgaatggcgggcgtgtacgaagacggcctgcgccggttcggcctgcccttttccgtgctcaacctgggtggcgggtttggcatcccgtacacggatgaggatgcgccgccggtggccgatctcgtccggggtgtgatccgcgccgccaaggcggcctttgcggcgcgaggcatggacgtgccggtgctctggattgaacccggccgaagcatcgtcgggcccgcgggcgtgacgctgtaccgcgtgggcagtcgcaaggtcattccgggcgtgcggaattacgtcgccatcgacgggggcatgacggacaacccgcgcctggcgctctatggcgcgaagtaccacgcgtgttacgcaaatcgggcggcggatccgccggatcgcccgtggtcggtggcgggcaagtgctgcgagagcggggacatgctcatctgggatctcccgcttccggatccgcagccgggggatctcctcgccgtcttcgcgaccggcgcgtacacgtatgcgatggcgagccactacaaccgcattcccaagcccgccgtcgtgttttgccgcgatggcgaggcgcgcctcgtggcgcggcgcgagacgtgggcggacgtggcgcggctcgatgtgccgcttcggtga

SEQ ID NO: 783 - protein, 485 aa, Alicyclobacillus acidocaldarius
MLDLRQLSRQYIAGEWRDGRSSRVHRDLNPFDGSTVAEIRLATVEDIDQAYRAAAEAQKVWAQVNPFERQAVMERALQIWEGYRDEVISLVADEIGGTFIKAAIEFELVKNFLREAATYPLRMEGRLLPATIPGKENRLLRLPAGVVGILSPFNFPMCLSMRALAPAIACGNGVVLKPHEEAAITGGALLAKVFEEAGVPKGLVNIVVADVAEIGDAFLEHPIPRIISFTGSTAVGRHIAEVAGRHLKRVTLELGGNSALIVLDDADLDLAVDAAVFSRFTHQGQICMCANRVIAVKDVYERFLGKFVERVSKLKMGSPRDPETVIGPLINRRQVERLLAVVDASIEQGARVAYRGPVDGNVVGPVVLADVGPEMACAKEEMFGPVVAVMPVEDEEEAVRAANDSEYGLTGAVITRDVERGVRIAMQVETGMFHVNDGTVNDEPLVAFGGEKGSGVGRYNGQWGIDEFTTLKWISIQRERRQYPI

SEQ ID NO: 784 - DNA, 1458 bp, Alicyclobacillus acidocaldarius
atgctcgatctcagacagctctcacgtcaatatatcgccggtgagtggcgcgacggacgcagttcccgcgtgcaccgagatctgaatccgttcgacggctcgacggtcgccgaaattcgccttgccacggtggaagacatcgaccaggcgtaccgcgccgccgcggaggcgcagaaggtctgggcgcaggtgaatccgtttgaacgccaggcggtcatggagcgagccctccagatttgggagggctatcgagatgaggtgatctcgctcgtcgcggacgagatcggaggtacattcatcaaggcggccattgagttcgaactggtgaagaacttcctgcgcgaggcggcgacgtaccctctgcgcatggaggggcggctgttgccggcgaccattcccgggaaagaaaatcgcctgctgcgcctgcctgccggggtggtggggatcctgagcccgtttaacttcccgatgtgcttgtcgatgcgcgctttggcgcctgccatcgcgtgtggcaacggcgttgtcctgaagccgcatgaagaagccgccatcacgggtggcgcgctgcttgcgaaggtgttcgaggaggcgggggtgccgaaggggctcgtcaacatcgtcgtggctgacgtcgcggagatcggcgatgcgttcttggagcacccgattccaagaatcatctcgttcaccggctccacagcggtcgggcggcatatcgcggaggtggcgggccggcacctgaagcgggtgacgctcgaactgggcggcaacagcgcgctcatcgtgctcgacgatgccgatctcgacctcgccgtcgacgccgcggtattcagccgtttcacgcatcagggccagatttgcatgtgcgccaatcgcgtgatcgccgtgaaggatgtgtacgagcgatttctcgggaaatttgtcgagcgcgtgtcgaaactgaagatgggcagtcctcgagatcccgagacggtcatcgggccgctcatcaaccgccgccaggtcgagcggctgctcgccgtcgtcgatgcgagcatcgagcagggcgctcgggtcgcctatcggggacccgtggacggaaacgtggtggggccggtggtgctggccgacgtggggccggagatggcgtgcgccaaagaggaaatgttcggccccgtggtggcggtcatgcccgtcgaggacgaggaagaggcggtgcgcgcggccaacgacagcgagtacggtctgacgggggccgtgatcacgcgcgacgtggagcgcggcgtgcggatcgccatgcaggtggagacgggcatgtttcacgtaaacgacggcacggtgaacgacgagcctctcgtggcgtttggcggcgagaagggttcgggcgtcgggcggtacaacggacagtggggtatcgacgagttcaccacgctcaaatggatctccattcagcgcgagcggcgccagtaccccatctga

SEQ ID NO: 785 - protein, 484 aa, Bacillus halodurans C-125
MFNIQDLNKQYIDGEWRDGKSPRVLRDRNPYNQEVLAEFQIATDSDVDAAYHAALKAQNEWATVNPYRKREILERAVTYIEEHEEEIVAIIIDELGGTRLKAAFEIGLVKNMIKEASTFPLRMEGKILPSTENGKENRLYRVPAGVVGVISPFNFPFFLSVKSVAPALGAGNGVVLKPHEETPITGGTLIAKIFEEAGVPKGLLNVVVTEIDEIGNAFVEHPIPRIISFTGSTNVGSHIGQLAVKHFKKPLLELGGNSAFLIFADADLDYAVQAATFSRFTHQGQICMSANRIFVQRDVYDEFVERYVTKVASLKVGDPRDPETVIGPVMNSRQAETLKQAIESGIAAGAKPVLHGAISGNMVEPTILIDASPEMAIAQEELFGPVVCVIPFDTEEEAVEMANDTKYGLSGAIHTANVERGVEIAKRIQTGMIHVNDITINDEPIVAFGGEKHSGLGRLNGEWSLEEFTTLKWVSVHYSQRVFP

SEQ ID NO: 786 - protein, 484 aa, Bacillus licheniformis ATCC 14580
MIQITDLNRQYIGGEWRDGQSESVLADLNPFTHKTIASFRKATREDVDAAYKAALEAKKKWDGVNPYEKRAILEKAAAYIEDNREAIVFLIMEELGGTRLKAAFEIDLVVNMIKEAAGFPLKMEGKILPSPVDGKENRIYRIPAGVVGVISPFNFPFFLSVKSVAPALGAGNGVVLKPHEETPICGGTLIAKIFEEAGLPKGLLNVVVTDIGEIGDSFVEHPIPRIISFTGSTKVGSYIGQLAIKHFKKPLLELGGNSALIVLEDADLEYAVNAATFSRFTHQGQICMSANRILVQKEVYPEFLKLFSQKVSGLKTGDPLDPETVIGPVINERQAEHLRKSIEKGIEEGATPLLKGDIKGNLVEPTILADVTPDMSVAKEELFGPVVCVMPFETEADAVEIANDTPFGLSGAVHTGNVESGVAIAKQIETGMIHVNDTTINDEPHVAFGGEKQSGIGRLNGEWSLDEFTTLKWISVQHQKRSFP

SEQ ID NO: 787 - protein, 484 aa, Bacillus amyloliquefaciens FZB42
MFQYEELNKQFIGGRWRDGSSRNVLENRNPYTQKVITSFQKATSDDVDAAYRAAALAKQEWDKVNPFKKRAILEKAVSFIEEHEEAIIYLIMEELGGTRLKAEFEIGLVKNMIKEAATFPVRMEGKILPSTIDGKENRLYRIPAGVVGVISPFNFPFFLSMKSVAPALGAGNGVVLKPHEETPICGGTLIAKIFEAAGVPDGLLNVIVTDIGEIGDSFVEHPVPRIISFTGSTGVGSYIGQLAVKHFKKPLLELGGNSALIVLEDADLEYAVNAAVFSRFTHQGQICMSANRVLVHTSVYDKFTELYEAKVSSLKVGDPMDPDTVIGPLINERQAEGLRRSVEKAIEEGAVPVLSGRFSGTVAEPVILKDVKPEMSIAKEELFGPAVCIMTFETEDEAVSIANATPFGLSGAVHTANVERGVEFAKRIETGMIHVNDTTINDEPNVAFGGEKQSGLGRLNGEWSLEEFTTLKWISVQHEKRQFP

SEQ ID NO: 788 - protein, 484 aa, Bacillus subtilis subsp. subtilis str. 168
MFQYEELNKQFIGGKWQEGSSPNVLENKNPYTQKTFTTFRKATADDVDEAYRAAALAKKKWDAVNPFEKRTILEKAVTYIEENEEAIIYLIMEELGGTRLKAAFEIGLVKNIIKEAATFPIRMEGKILPSTIDGKENRLYRVPAGVVGVISPFNFPFFLSMKSVAPALGAGNGVVLKPHEETPICGGTLIAKIFENAGIPAGLLNVVVTDIAEIGDSFVEHPVPRIISFTGSTKVGSYIGQLAMKHFKKPLLELGGNSAFIVLEDADIEYAVNAAVFSRFTHQGQICMSANRVLVHSSIYDKFLELYQAKVESLKVGDPMDPDTIIGPLINSRQTDGLMKTVEQAIEEGAVPVKLGGFNGTIVEPTILKDVKPFMSIAKEELFGPVVSFMKFDSEDEAVDIANETPFGLSGAVHTSNLERGVAFAKRIETGMIHVNDTTINDEPNVAFGGEKQSGLGRLNGEWSLEEFTTLKWISVQHEKRSFP

SEQ ID NO: 789 - protein, 479 aa, Oceanobacillus iheyensis HTE831
QLDSQYINGVWKDGNGKATIQNTNPYSGEVIATYRAASLQDLDDAYETAQEVQKAWAKENPITVQRIMDKAVTYMEENHEEIVDIIIQEIGGTRLKAEFEIGLVTNMIKEASSFPMRMSGSILPSPIDGKENRVYRVPVGVVGVISPFNFPFFLSMKSVAPALATGNAVVLKPHEHTAITGGTMIAKIFEEAGLPKGVLQVVTTEISEIGDRFVDHPVPAAISFTGSTKVGKHIGEVASRNLKEVHLELGGNSALIVLEDADVDYAVSAGVFSRFTHQGQICMSANRIIVHEDVYDEFVQKYADKVKTLTCGDPADSSTIIGPLINERQVQNTVNLIEKGVEEGAHPLVRGQVNGNVVEPVIFTEVTPDMQIANEEFFAPVVAIMKVSSEEQAIAYANASSYGLSGAVHTSDVNRGAEVAKQLESGMIHINDGTINDEPNVAFGGVKNSGVGRLNGEWSLEAFTTTKWISIQHTKRQFP

SEQ ID NO: 790 - protein, 485 aa, Artificial
  Substituion in SEQ ID NO 783
MLDLRQLSRQYIAGEWRDGRSSRVHRDLNPFDGSTVAEIRLATVEDIDQAYRAAAEAQKVWAQVNPFERQAVMERALQIWEGYRDEVISLVADEIGGTFIKAAIEFELVKNFLREAATYPLRMEGRLLPATIPGKENRLLRLPAGVVGILSPFNFPMCLSMRALAPAIACGNGVVLKPHEEAAITGGALLAKVFEEAGVPKGLVNIVVADVAEIGDAFLEHPIPRIISFTGSTAVGRHIAEVAGRHLKRVTLELGGNSALIVLDDADLDLAVDAAVFSRFTHQGQICMCANRVIAVKDVYERFLGKFVERVSKLKMGSPRDPETVIGPLINRRQVERLLAVVDASIEQGARVAYRGPVDGNVVGPVVLADVGPEMACAKEEMFGPVVAVMPVEDEEEAVRAANDSEYGLTGAVITRDVERGVRIAMQVETGMFHVNDGTVNDEPIVAFGGEKGSGVGRYNGQWGIDEFTTLKWISIQRERRQYPI

SEQ ID NO: 791 - protein, 485 aa, Artificial
  Substituion in SEQ ID NO 783
MLDLRQLSRQYIAGEWRDGRSSRVHRDLNPFDGSTVAEIRLATVEDIDQAYRAAAEAQKVWAQVNPFERQAVMERALQIWEGYRDEVISLVADEIGGTFIKAAIEFELVKNFLREAATYPLRMEGRLLPATIPGKENRLLRLPAGVVGILSPFNFPMCLSMRALAPAIACGNGVVLKPHEEAAITGGALLAKVFEEAGVPKGLVNIVVADVAEIGDAFLEHPIPRIISFTGSTAVGRHIAEVAGRHLKRVTLELGGNSALIVLDDADLDLAVDAAVFSRFTHQGQICMCANRVIAVKDVYERFLGRFVERVSKLKMGSPRDPETVIGPLINRRQVERLLAVVDASIEQGARVAYRGPVDGNVVGPVVLADVGPEMACAKEEMFGPVVAVMPVEDEEEAVRAANDSEYGLTGAVITRDVERGVRIAMQVETGMFHVNDGTVNDEPLVAFGGEKGSGVGRYNGQWGIDEFTTLKWISIQRERRQYPI

SEQ ID NO: 792 - protein, 485 aa, Artificial
  Substituion in SEQ ID NO 783
MLDLRQLSRQYIAGEWRDGRSSRVHRDLNPFDGSTVAEIRLATVEDIDQAYRAAAEAQKVWAQINPFERQAVMERALQIWEGYRDEVISLVADEIGGTFIKAAIEFELVKNFLREAATYPLRMEGRLLPATIPGKENRLLRLPAGVVGILSPFNFPMCLSMRALAPAIACGNGVVLKPHEEAAITGGALLAKVFEEAGVPKGLVNIVVADVAEIGDAFLEHPIPRIISFTGSTAVGRHIAEVAGRHLKRVTLELGGNSALIVLDDADLDLAVDAAVFSRFTHQGQICMCANRVIAVKDVYERFLGKFVERVSKLKMGSPRDPETVIGPLINRRQVERLLAVVDASIEQGARVAYRGPVDGNVVGPVVLADVGPEMACAKEEMFGPVVAVMPVEDEEEAVRAANDSEYGLTGAVITRDVERGVRIAMQVETGMFHVNDGTVNDEPLVAFGGEKGSGVGRYNGQWGIDEFTTLKWISIQRERRQYPI

SEQ ID NO: 793 - protein, 485 aa, Artificial
  Substituion in SEQ ID NO 783
MLDLRQLSRQYIAGEWRDGRSSRVHRDLNPFDGSTVAEIRLATVEDIDQAYRAAAEAQKVWAQVNPFERQAVMERALQIWEGYRDEVISLVADEIGGTFIKAAIEFELVKNFLREAATYPLRMEGRLLPATLPGKENRLLRLPAGVVGILSPFNFPMCLSMRALAPAIACGNGVVLKPHEEAAITGGALLAKVFEEAGVPKGLVNIVVADVAEIGDAFLEHPIPRIISFTGSTAVGRHIAEVAGRHLKRVTLELGGNSALIVLDDADLDLAVDAAVFSRFTHQGQICMCANRVIAVKDVYERFLGKFVERVSKLKMGSPRDPETVIGPLINRRQVERLLAVVDASIEQGARVAYRGPVDGNVVGPVVLADVGPEMACAKEEMFGPVVAVMPVEDEEEAVRAANDSEYGLTGAVITRDVERGVRIAMQVETGMFHVNDGTVNDEPLVAFGGEKGSGVGRYNGQWGIDEFTTLKWISIQRERRQYPI

SEQ ID NO: 794 - protein, 485 aa, Artificial
  Substituion in SEQ ID NO 783
MLDLRQLSRQYIAGEWRDGRSSRVHRDLNPFDGSTVAEIRLATVEDIDQAYRAAAEAQKVWAQVNPFERQAVMERALQIWEGYRDEVISLVADEIGGTFIKAAIEFELVKNFLREAATYPLRMEGRLLPATIPGKENRLLRLPAGVVGILSPFNFPMCLSMRALAPAIACGNGVVLKPHEEAAITGGALLAKVFEEAGVPKGLVNIVVADVAEIGDAFLEHPIPRIISFTGSTAVGRHIAEVAGRHLKRVTLELGGNSALIVLDDADLDLAVDAAVFSRFTHQGQICMCANRVIAVKDVYERFLGKFVERVSKLKMGSPRDPETVIGPLINRRQVEKLLAVVDASIEQGARVAYRGPVDGNVVGPVVLADVGPEMACAKEEMFGPVVAVMPVEDEEEAVRAANDSEYGLTGAVITRDVERGVRIAMQVETGMFHVNDGTVNDEPLVAFGGEKGSGVGRYNGQWGIDEFTTLKWISIQRERRQYPI

SEQ ID NO: 795 - DNA, 1458 bp, Artificial
  Substituion in SEQ ID NO 784
atgctcgatctcagacagctctcacgtcaatatatcgccggtgagtggcgcgacggacgcagttcccgcgtgcaccgagatctgaatccgttcgacggctcgacggtcgccgaaattcgccttgccacggtggaagacatcgaccaggcgtaccgcgccgccgcggaggcgcagaaggtctgggcgcaggtgaatccgtttgaacgccaggcggtcatggagcgagccctccagatttgggagggctatcgagatgaggtgatctcgctcgtcgcggacgagatcggaggtacattcatcaaggcggccattgagttcgaactggtgaagaacttcctgcgcgaggcggcgacgtaccctctgcgcatggaggggcggctgttgccggcgaccattcccgggaaagaaaatcgcctgctgcgcctgcctgccggggtggtggggatcctgagcccgtttaacttcccgatgtgcttgtcgatgcgcgctttggcgcctgccatcgcgtgtggcaacggcgttgtcctgaagccgcatgaagaagccgccatcacgggtggcgcgctgcttgcgaaggtgttcgaggaggcgggggtgccgaaggggctcgtcaacatcgtcgtggctgacgtcgcggagatcggcgatgcgttcttggagcacccgattccaagaatcatctcgttcaccggctccacagcggtcgggcggcatatcgcggaggtggcgggccggcacctgaagcgggtgacgctcgaactgggcggcaacagcgcgctcatcgtgctcgacgatgccgatctcgacctcgccgtcgacgccgcggtattcagccgtttcacgcatcagggccagatttgcatgtgcgccaatcgcgtgatcgccgtgaaggatgtgtacgagcgatttctcgggaaatttgtcgagcgcgtgtcgaaactgaagatgggcagtcctcgagatcccgagacggtcatcgggccgctcatcaaccgccgccaggtcgagcggctgctcgccgtcgtcgatgcgagcatcgagcagggcgctcgggtcgcctatcggggacccgtggacggaaacgtggtggggccggtggtgctggccgacgtggggccggagatggcgtgcgccaaagaggaaatgttcggccccgtggtggcggtcatgcccgtcgaggacgaggaagaggcggtgcgcgcggccaacgacagcgagtacggtctgacgggggccgtgatcacgcgcgacgtggagcgcggcgtgcggatcgccatgcaggtggagacgggcatgtttcacgtaaacgacggcacggtgaacgacgagcctattgtggcgtttggcggcgagaagggttcgggcgtcgggcggtacaacggacagtggggtatcgacgagttcaccacgctcaaatggatctccattcagcgcgagcggcgccagtaccccatctga

SEQ ID NO: 796 - DNA, 1458 bp, Artificial
  Substituion in SEQ ID NO 784
atgctcgatctcagacagctctcacgtcaatatatcgccggtgagtggcgcgacggacgcagttcccgcgtgcaccgagatctgaatccgttcgacggctcgacggtcgccgaaattcgccttgccacggtggaagacatcgaccaggcgtaccgcgccgccgcggaggcgcagaaggtctgggcgcaggtgaatccgtttgaacgccaggcggtcatggagcgagccctccagatttgggagggctatcgagatgaggtgatctcgctcgtcgcggacgagatcggaggtacattcatcaaggcggccattgagttcgaactggtgaagaacttcctgcgcgaggcggcgacgtaccctctgcgcatggaggggcggctgttgccggcgaccattcccgggaaagaaaatcgcctgctgcgcctgcctgccggggtggtggggatcctgagcccgtttaacttcccgatgtgcttgtcgatgcgcgctttggcgcctgccatcgcgtgtggcaacggcgttgtcctgaagccgcatgaagaagccgccatcacgggtggcgcgctgcttgcgaaggtgttcgaggaggcgggggtgccgaaggggctcgtcaacatcgtcgtggctgacgtcgcggagatcggcgatgcgttcttggagcacccgattccaagaatcatctcgttcaccggctccacagcggtcgggcggcatatcgcggaggtggcgggccggcacctgaagcgggtgacgctcgaactgggcggcaacagcgcgctcatcgtgctcgacgatgccgatctcgacctcgccgtcgacgccgcggtattcagccgtttcacgcatcagggccagatttgcatgtgcgccaatcgcgtgatcgccgtgaaggatgtgtacgagcgatttctcgggcgttttgtcgagcgcgtgtcgaaactgaagatgggcagtcctcgagatcccgagacggtcatcgggccgctcatcaaccgccgccaggtcgagcggctgctcgccgtcgtcgatgcgagcatcgagcagggcgctcgggtcgcctatcggggacccgtggacggaaacgtggtggggccggtggtgctggccgacgtggggccggagatggcgtgcgccaaagaggaaatgttcggccccgtggtggcggtcatgcccgtcgaggacgaggaagaggcggtgcgcgcggccaacgacagcgagtacggtctgacgggggccgtgatcacgcgcgacgtggagcgcggcgtgcggatcgccatgcaggtggagacgggcatgtttcacgtaaacgacggcacggtgaacgacgagcctctcgtggcgtttggcggcgagaagggttcgggcgtcgggcggtacaacggacagtggggtatcgacgagttcaccacgctcaaatggatctccattcagcgcgagcggcgccagtaccccatctga

SEQ ID NO: 797 - DNA, 1458 bp, Artificial
  Substituion in SEQ ID NO 784
atgctcgatctcagacagctctcacgtcaatatatcgccggtgagtggcgcgacggacgcagttcccgcgtgcaccgagatctgaatccgttcgacggctcgacggtcgccgaaattcgccttgccacggtggaagacatcgaccaggcgtaccgcgccgccgcggaggcgcagaaggtctgggcgcagattaatccgtttgaacgccaggcggtcatggagcgagccctccagatttgggagggctatcgagatgaggtgatctcgctcgtcgcggacgagatcggaggtacattcatcaaggcggccattgagttcgaactggtgaagaacttcctgcgcgaggcggcgacgtaccctctgcgcatggaggggcggctgttgccggcgaccattcccgggaaagaaaatcgcctgctgcgcctgcctgccggggtggtggggatcctgagcccgtttaacttcccgatgtgcttgtcgatgcgcgctttggcgcctgccatcgcgtgtggcaacggcgttgtcctgaagccgcatgaagaagccgccatcacgggtggcgcgctgcttgcgaaggtgttcgaggaggcgggggtgccgaaggggctcgtcaacatcgtcgtggctgacgtcgcggagatcggcgatgcgttcttggagcacccgattccaagaatcatctcgttcaccggctccacagcggtcgggcggcatatcgcggaggtggcgggccggcacctgaagcgggtgacgctcgaactgggcggcaacagcgcgctcatcgtgctcgacgatgccgatctcgacctcgccgtcgacgccgcggtattcagccgtttcacgcatcagggccagatttgcatgtgcgccaatcgcgtgatcgccgtgaaggatgtgtacgagcgatttctcgggaaatttgtcgagcgcgtgtcgaaactgaagatgggcagtcctcgagatcccgagacggtcatcgggccgctcatcaaccgccgccaggtcgagcggctgctcgccgtcgtcgatgcgagcatcgagcagggcgctcgggtcgcctatcggggacccgtggacggaaacgtggtggggccggtggtgctggccgacgtggggccggagatggcgtgcgccaaagaggaaatgttcggccccgtggtggcggtcatgcccgtcgaggacgaggaagaggcggtgcgcgcggccaacgacagcgagtacggtctgacgggggccgtgatcacgcgcgacgtggagcgcggcgtgcggatcgccatgcaggtggagacgggcatgtttcacgtaaacgacggcacggtgaacgacgagcctctcgtggcgtttggcggcgagaagggttcgggcgtcgggcggtacaacggacagtggggtatcgacgagttcaccacgctcaaatggatctccattcagcgcgagcggcgccagtaccccatctga

SEQ ID NO: 798 - DNA, 1458 bp, Artificial
  Substituion in SEQ ID NO 784
atgctcgatctcagacagctctcacgtcaatatatcgccggtgagtggcgcgacggacgcagttcccgcgtgcaccgagatctgaatccgttcgacggctcgacggtcgccgaaattcgccttgccacggtggaagacatcgaccaggcgtaccgcgccgccgcggaggcgcagaaggtctgggcgcaggtgaatccgtttgaacgccaggcggtcatggagcgagccctccagatttgggagggctatcgagatgaggtgatctcgctcgtcgcggacgagatcggaggtacattcatcaaggcggccattgagttcgaactggtgaagaacttcctgcgcgaggcggcgacgtaccctctgcgcatggaggggcggctgttgccggcgaccttacccgggaaagaaaatcgcctgctgcgcctgcctgccggggtggtggggatcctgagcccgtttaacttcccgatgtgcttgtcgatgcgcgctttggcgcctgccatcgcgtgtggcaacggcgttgtcctgaagccgcatgaagaagccgccatcacgggtggcgcgctgcttgcgaaggtgttcgaggaggcgggggtgccgaaggggctcgtcaacatcgtcgtggctgacgtcgcggagatcggcgatgcgttcttggagcacccgattccaagaatcatctcgttcaccggctccacagcggtcgggcggcatatcgcggaggtggcgggccggcacctgaagcgggtgacgctcgaactgggcggcaacagcgcgctcatcgtgctcgacgatgccgatctcgacctcgccgtcgacgccgcggtattcagccgtttcacgcatcagggccagatttgcatgtgcgccaatcgcgtgatcgccgtgaaggatgtgtacgagcgatttctcgggaaatttgtcgagcgcgtgtcgaaactgaagatgggcagtcctcgagatcccgagacggtcatcgggccgctcatcaaccgccgccaggtcgagcggctgctcgccgtcgtcgatgcgagcatcgagcagggcgctcgggtcgcctatcggggacccgtggacggaaacgtggtggggccggtggtgctggccgacgtggggccggagatggcgtgcgccaaagaggaaatgttcggccccgtggtggcggtcatgcccgtcgaggacgaggaagaggcggtgcgcgcggccaacgacagcgagtacggtctgacgggggccgtgatcacgcgcgacgtggagcgcggcgtgcggatcgccatgcaggtggagacgggcatgtttcacgtaaacgacggcacggtgaacgacgagcctctcgtggcgtttggcggcgagaagggttcgggcgtcgggcggtacaacggacagtggggtatcgacgagttcaccacgctcaaatggatctccattcagcgcgagcggcgccagtaccccatctga

SEQ ID NO: 799 - DNA, 1458 bp, Artificial
  Substituion in SEQ ID NO 784
atgctcgatctcagacagctctcacgtcaatatatcgccggtgagtggcgcgacggacgcagttcccgcgtgcaccgagatctgaatccgttcgacggctcgacggtcgccgaaattcgccttgccacggtggaagacatcgaccaggcgtaccgcgccgccgcggaggcgcagaaggtctgggcgcaggtgaatccgtttgaacgccaggcggtcatggagcgagccctccagatttgggagggctatcgagatgaggtgatctcgctcgtcgcggacgagatcggaggtacattcatcaaggcggccattgagttcgaactggtgaagaacttcctgcgcgaggcggcgacgtaccctctgcgcatggaggggcggctgttgccggcgaccattcccgggaaagaaaatcgcctgctgcgcctgcctgccggggtggtggggatcctgagcccgtttaacttcccgatgtgcttgtcgatgcgcgctttggcgcctgccatcgcgtgtggcaacggcgttgtcctgaagccgcatgaagaagccgccatcacgggtggcgcgctgcttgcgaaggtgttcgaggaggcgggggtgccgaaggggctcgtcaacatcgtcgtggctgacgtcgcggagatcggcgatgcgttcttggagcacccgattccaagaatcatctcgttcaccggctccacagcggtcgggcggcatatcgcggaggtggcgggccggcacctgaagcgggtgacgctcgaactgggcggcaacagcgcgctcatcgtgctcgacgatgccgatctcgacctcgccgtcgacgccgcggtattcagccgtttcacgcatcagggccagatttgcatgtgcgccaatcgcgtgatcgccgtgaaggatgtgtacgagcgatttctcgggaaatttgtcgagcgcgtgtcgaaactgaagatgggcagtcctcgagatcccgagacggtcatcgggccgctcatcaaccgccgccaggtcgagaaactgctcgccgtcgtcgatgcgagcatcgagcagggcgctcgggtcgcctatcggggacccgtggacggaaacgtggtggggccggtggtgctggccgacgtggggccggagatggcgtgcgccaaagaggaaatgttcggccccgtggtggcggtcatgcccgtcgaggacgaggaagaggcggtgcgcgcggccaacgacagcgagtacggtctgacgggggccgtgatcacgcgcgacgtggagcgcggcgtgcggatcgccatgcaggtggagacgggcatgtttcacgtaaacgacggcacggtgaacgacgagcctctcgtggcgtttggcggcgagaagggttcgggcgtcgggcggtacaacggacagtggggtatcgacgagttcaccacgctcaaatggatctccattcagcgcgagcggcgccagtaccccatctga

SEQ ID NO: 800 - protein, 370 aa, Alicyclobacillus acidocaldarius
MLAEHDRAERLMEIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLRLYLESQKLWSESDEAKLQDEVKARVEAAVEEALSIAPPDMEMMFDHVYAEEPWHLAAEREEYRRTREGVSV

SEQ ID NO: 801 - DNA, 1113 bp, Alicyclobacillus acidocaldarius
atgttggccgaacacgatcgggcagagcggctcatggaaatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcctgtacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgagcgcgaggagtaccgcaggacccgcgagggggtatccgtatga

SEQ ID NO: 802 - protein, 337 aa, Bacillus sp. UTB2301
EHQFPKIQIVDENGNIVDSKYEDKLTPEFIKELYERLMFVRTFDRKAISLQRQGRLGTYAPFEGQEAAQVGSALALEKDDWLFPTYRDHAATITFGHKLSTVFLYWNGRVEGCVPPEGKKIFPPAVPIATQLPHATGAAMAEKYKGTKNAAIVYFGDGATSEGDFHEGLNFASVFKAPVVFFNQNNSFAISVPIHKQMNSKTIAQKSVAYGIPGIRLDGNDIFAVYFYTKEALDRARNGEGPTLIEAVTWRYGAHTTADDPTKYRNQEESLERREKYDPILRVERLMKNKGIWDEKWAASVEEKASQTIEEAVKEMEAFPAPDVNDLFDHVFEKPTW

SEQ ID NO: 803 - protein, 311 aa, Bacillus halodurans C-125
VLSMYKQMINCREFDEKALKLQRQGRIGTYASFKGQEACQIGGALALRPTDWLFPTYRDHAAISTHGQPWHRIFLYWMGHMDGSLSPDDRNILPPAVPIATQMLHAVGTAWADKLKGNPHVSLVFFGDGATSEGDFHEALNFAGVYQTPTIFFCQNNGYAISVPFEKQSASKTIKQRSVAYDMRGERVDGNDIFAVYLTVKRAIEQARKGRGPTLIEAVTTRFGSHTTADDAKKYRDQEEIERTWKEMQDPLTRLKAYIQAKGWLSEEEEAQMKAKIRETIDEELSMAEQYPKPSISQMFEHVYENQPWYV

SEQ ID NO: 804 - protein, 332 aa, Geobacillus thermodenitrificans NG80-2
VLNEEGTVVQPEYRERITKELTMVMYRHLIRTRTFDRKCVSLQRQGRIGTYVPYEGQEACQVGSALALNDEDWMFPTYRDHGAMMTFGRSLVNTLLYWKGRTEGCVPPEGKKIVPPSVPIATQLPHAAGAACAEKWKGTKNAVIVYFGDGATSEGDFHEGLNFASVFNAPVVFFNQNNQYAISVPITRQMRSKTIAQKALAYDIPGVRIDGNDVFAVYFQTAEALERARHGGGPTLIEAVTWRYGAHTTSDDPSRYRDQEESKKRRETTDPIKRVVRLMQREGWWNEQWANQVQEEVNAEIEQAVAEMERYPKANASDMFDYVFAEPTWTIA

SEQ ID NO: 805 - protein, 329 aa, Bacillus sp. NRRL B-14911
MIDENGNEVSGTSGFDTELALEFYRQLVRIRVFDRKAVSLQRQGRIGTYAPFEGQEAAQIGSAMALEESDWMFPTYRDHGAALAFGHSMRNVLLFWNGRNEGCIPPEGKNIFPPGIPIATQIPHAAGAAYAEKRKGTKKAAIVYFGDGATSEGDFHEGLNFASIVKAPVVFFNQNNQYAISVPLSKQMNTKTIAQKSLAYDIPGVRVDGNDVFAVYRETKKALERAREGGGPTLIEAVTWRYGAHTTADDPAKYRDQQESSVLRGKIDPILRMERWLKNKDLYDENWAKRAESEAAAEIDLAIAEMEAYPPADPADIFDHVFAELIWPL

SEQ ID NO: 806 - protein, 350 aa, Bacillus sp. SG-1
MIQSRDRGEEMEEQFPIKRIIDNDGTLLGDKDPGITEQLAKEFYRHMVRIRTFDKKAISLQRQGRIGTYAPFEGQEASQVGSSAALKEDDWMFPSYRDHGAAMTFGHSLRNILLFWKGRNEGCVPPQGKKIFPPGIPIATQLPHAAGAAYAEMRKGTKNAAIVYFGDGATSEGDFHEGLNVASVLNAPVVFFNQNNGFAISVPIKKQMKTKTIAQKALAYDIPGVRIDGNDIFAVYFETLKALERARNGEGPTLIEAVTWRYGAHTTADDPTKYRDQSESDERRKLGDPIARLQRYMERQGWWDQEWADSVQKEYTAEMDQAVEELESYPEADPKVIFDYVFEKPTWTIS

SEQ ID NO: 807 - protein, 370 aa, Artificial
  Substituion in SEQ ID NO 800
MLAEHDRAERLMEIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVIHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLRLYLESQKLWSESDEAKLQDEVKARVEAAVEEALSIAPPDMEMMFDHVYAEEPWHLAAEREEYRRTREGVSV

SEQ ID NO: 808 - protein, 370 aa, Artificial
  Substituion in SEQ ID NO 800
MLAEHDRAERLMEIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLRLYLESQKLWSESDEAKLQDEVKARVEAAVEEALSIAPPDMEMMFDHVYAEEPWHLAADREEYRRTREGVSV

SEQ ID NO: 809 - protein, 370 aa, Artificial
  Substituion in SEQ ID NO 800
MLAEHDRAERLMDIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLRLYLESQKLWSESDEAKLQDEVKARVEAAVEEALSIAPPDMEMMFDHVYAEEPWHLAAEREEYRRTREGVSV

SEQ ID NO: 810 - protein, 370 aa, Artificial
  Substituion in SEQ ID NO 800
MLAEHDRAERLMEIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLRIYLESQKLWSESDEAKLQDEVKARVEAAVEEALSIAPPDMEMMFDHVYAEEPWHLAAEREEYRRTREGVSV

SEQ ID NO: 811 - protein, 370 aa, Artificial
  Substituion in SEQ ID NO 800
MLAEHDRAERLMEIAKAEGLYEEIHLLREDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLRLYLESQKLWSESDEAKLQDEVKARVEAAVEEALSIAPPDMEMMFDHVYAEEPWHLAAEREEYRRTREGVSV

SEQ ID NO: 812 - DNA, 1113 bp, Artificial
  Substituion in SEQ ID NO 801
atgttggccgaacacgatcgggcagagcggctcatggaaatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgattcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcctgtacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgagcgcgaggagtaccgcaggacccgcgagggggtatccgtatga

SEQ ID NO: 813 - DNA, 1113 bp, Artificial
  Substituion in SEQ ID NO 801
atgttggccgaacacgatcgggcagagcggctcatggaaatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcctgtacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgatcgcgaggagtaccgcaggacccgcgagggggtatccgtatga

SEQ ID NO: 814 - DNA, 1113 bp, Artificial
  Substituion in SEQ ID NO 801
atgttggccgaacacgatcgggcagagcggctcatggatatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcctgtacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgagcgcgaggagtaccgcaggacccgcgagggggtatccgtatga

SEQ ID NO: 815 - DNA, 1113 bp, Artificial
  Substituion in SEQ ID NO 801
atgttggccgaacacgatcgggcagagcggctcatggaaatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcatttacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgagcgcgaggagtaccgcaggacccgcgagggggtatccgtatga

SEQ ID NO: 816 - DNA, 1113 bp, Artificial
  Substituion in SEQ ID NO 801
atgttggccgaacacgatcgggcagagcggctcatggaaatcgccaaggcggaagggctgtacgaggagattcacctcctgcgtgaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcctgtacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgagcgcgaggagtaccgcaggacccgcgagggggtatccgtatga

SEQ ID NO: 817 - protein, 327 aa, Alicyclobacillus acidocaldarius
MSRMLNLVQAINEALDLKLADDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIVSLINEEALLYLRAPIKRIAGFDVPVPFFALEDEYMPTEARIRAGIEETITF

SEQ ID NO: 818 - DNA, 984 bp, Alicyclobacillus acidocaldarius
atgagcaggatgttgaacctggtccaagccatcaacgaagcgctcgatctcaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctaccttcgagcgcccatcaagcggattgctgggttcgatgtgccggtgccgttcttcgcactggaggacgagtacatgccgaccgaagcgcgcattcgcgcggggattgaagagaccatcacgttctga

SEQ ID NO: 819 - protein, 326 aa, Bacillus halodurans C-125
SQQQTMLQAINQTLDDLLATNDDVMLLGEDIGINGGVFRATDGLYEKYGKDRVVDTPLAESGIIGSAIGLAMNGKRPIVEIQFLAFIYPGFEQLISHAARMRYRTRGQYNVPMVIRTPYGAGIRGPELHSESVEAFFAHTPGLKVVAPSNPYDAKGLLTAATSDPDPVIFLEDTKLYRAFKEDVPNTLYEIPLGQAKVVQEGEDVTVIAWGGMVREALQAAKEAEKAHGWSCEIIDLRTIAPIDRETIIESVKKTGRAIIIHEAHKTAGLGGEITALINEEALIYLKAPVKRIAGFDIPVPQFLSENQYLPTIERMFRGIEETVSF

SEQ ID NO: 820 - protein, 322 aa, Bacillus sp. UTB2301
LTLVQAVTDGLRTMLKEKKEVIVLGEDVGKNGGVFRATDGLQEEFGEDRVIDTPLSEAGIVGVSIGMAINGMLPVAEIQFLGFIYPAYEQIMTHASRIRMRTMSKFHVPLVIRAPYGAGVRAPEIHSDSVETLFTHMPGIKVVCPSTPYDAKGLLIAAIEDPDPVLFMESMKLYRSSREDVPEGKYTVEIGKARKVRDGKDVSIFAWGAMVPVATKAAEEMEKKGVTCDVIDLRTLYPLDKDAIAESVQKTGRVVIVHEAHATGGVSNDVMAVINDTAFLYLKAPIERVTGFDVPVPFFTLEEHYLPNTGRVVKAIEKVIHF

SEQ ID NO: 821 - protein, 323 aa, Geobacillus thermodenitrificans NG80-2
TKSLTLVQAVNDALRIMLKERDDVVLLGEDVGRNGGVFRATDGLLQEFGEERVIDTPLSEAGFTGAAIGMALNGFRPVVEIQFLGFIYPAYEQIMTHAARMRSRTRGHFTVPLVIRAPYGAGVRAPEIHSDSTEALFTHMPGVKVVCPSSPYDAKGLLIAAIEDPDPVLFLEPMRNYRAFREDVPEGKYTVDIGKGKKLREGEDVTVIAWGAMVPVAMKAAEAAAKKGIDADVIDLRTLYPLDKDMIAESVQKTGRTVIVQEAHATGGLANDILAVINDTSFFYQKAPAERVTGFDVPVPFFAHEDDYLPTPARVLHAIEKVM

SEQ ID NO: 822 - protein, 325 aa, Oceanobacillus iheyensis HTE831
TKQLTLIQAITDGMRTMLHEREEVVVLGEDVGKNGGVFRATDGLQEEFGEKRVFDTPLSEAGIIGSSIGMAINGLLPVAEIQFSGFIYPAYEQIMTHATRMRYRTKGVFTVPLVIRAPYGAGVRAPEIHSDSMEALFTHMPGIKVVCPSSPYDAKGLLISAIEDPDPVLFLEPLKLYRAVRGEVPEEKYEIEIGKGKYLREGDDVTVIAWGAMVPVAMKAAEQAAEKGITCEVIDLRTLYPIDRAIIAESVQKTGRCVVVHEAPATGGLGNDIISIVNDTSFLYMKSPIERVTGADVHVPFWALEEHNIPTPARVMDAINQVINF

SEQ ID NO: 823 - protein, 322 aa, Exiguobacterium sibiricum 255-15
MTLVQAVTDALRTKLTDDETTLVLGEDVGKNGGVFRATDGLQEEFGEDRIIDTPLSEAGIVGTSIGLAVNGFKPIVEIQFLGFIYPAYEQIMTHVSRIRMRTMGRYGVPMVIRAPYGAGIRAPEIHSDSTEALFTSMPGLKVVCPSTPYDAKGLLIAAIEDPDPVLFLESMRSYRAFKEPVPSEAYTIEIGKANCITEGQDVTLIAWGAMVQVAQKAATEAATRGISCEVIDLRTLYPLDRETISASVQKTGRAVIIHEAQATGGLGNDLLALINDTSFLYLRAPVARVTGFDVPVPLFALEDHYIPTPTRVLEAIQRTVDF

SEQ ID NO: 824 - protein, 327 aa, Artificial
  Substituion in SEQ ID NO 817
MSRMLNLVQAINEALDLKLADDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIVSLINEEALLYLRAPIKRIAGFDVPVPFFALEDEYMPTDARIRAGIEETITF

SEQ ID NO: 825 - protein, 327 aa, Artificial
  Substituion in SEQ ID NO 817
MSRMLNLVQAINEALDLKLADDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIEKERGWTCDVIDLRTLYPLDRDAIVESVQKTGRAVVVHEAHKTAGLGAEIVSLINEEALLYLRAPIKRIAGFDVPVPFFALEDEYMPTEARIRAGIEETITF

SEQ ID NO: 826 - protein, 327 aa, Artificial
  Substituion in SEQ ID NO 817
MSRMLNLVQAINEALDLKLADDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIVSLINEEALLYIRAPIKRIAGFDVPVPFFALEDEYMPTEARIRAGIEETITF

SEQ ID NO: 827 - protein, 327 aa, Artificial
  Substituion in SEQ ID NO 817
MSRMLNLVQAINEALDLKLAEDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIVSLINEEALLYLRAPIKRIAGFDVPVPFFALEDEYMPTEARIRAGIEETITF

SEQ ID NO: 828 - protein, 327 aa, Artificial
  Substituion in SEQ ID NO 817
MSRMLNLVQAINEALDIKLADDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIVSLINEEALLYLRAPIKRIAGFDVPVPFFALEDEYMPTEARIRAGIEETITF

SEQ ID NO: 829 - DNA, 984 bp, Artificial
  Substituion in SEQ ID NO 818
atgagcaggatgttgaacctggtccaagccatcaacgaagcgctcgatctcaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctaccttcgagcgcccatcaagcggattgctgggttcgatgtgccggtgccgttcttcgcactggaggacgagtacatgccgaccgatgcgcgcattcgcgcggggattgaagagaccatcacgttctga

SEQ ID NO: 830 - DNA, 984 bp, Artificial
  Substituion in SEQ ID NO 818
atgagcaggatgttgaacctggtccaagccatcaacgaagcgctcgatctcaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagaaagagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctaccttcgagcgcccatcaagcggattgctgggttcgatgtgccggtgccgttcttcgcactggaggacgagtacatgccgaccgaagcgcgcattcgcgcggggattgaagagaccatcacgttctga

SEQ ID NO: 831 - DNA, 984 bp, Artificial
  Substituion in SEQ ID NO 818
atgagcaggatgttgaacctggtccaagccatcaacgaagcgctcgatctcaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctacattcgagcgcccatcaagcggattgctgggttcgatgtgccggtgccgttcttcgcactggaggacgagtacatgccgaccgaagcgcgcattcgcgcggggattgaagagaccatcacgttctga

SEQ ID NO: 832 - DNA, 984 bp, Artificial
  Substituion in SEQ ID NO 818
atgagcaggatgttgaacctggtccaagccatcaacgaagcgctcgatctcaagctcgcggaagatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctaccttcgagcgcccatcaagcggattgctgggttcgatgtgccggtgccgttcttcgcactggaggacgagtacatgccgaccgaagcgcgcattcgcgcggggattgaagagaccatcacgttctga

SEQ ID NO: 833 - DNA, 984 bp, Artificial
  Substituion in SEQ ID NO 818
atgagcaggatgttgaacctggtccaagccatcaacgaagcgctcgatattaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctaccttcgagcgcccatcaagcggattgctgggttcgatgtgccggtgccgttcttcgcactggaggacgagtacatgccgaccgaagcgcgcattcgcgcggggattgaagagaccatcacgttctga

SEQ ID NO: 834 - protein, 343 aa, Alicyclobacillus acidocaldarius
MRSRPPKEVHDMTTFRAHMVEQDGNAHRAGVRELTLDQLPEGEVLIRVRYSSVNYKDGICSQPASRLVTRYPMVLGIDLAGEVVESRDARFRPGDPVICTSYDLGTGHFGGFSEYARVPADWVVPLPDGLSLRDAMVLGTAGFTAALSLYRMEQNGVSPAMGAMLVTGATGGVGATGIAIAKRAGYRVVASTRKDEAAEWLKTLGADDVVRPDALLLQEGESYLNVKTRYAGVIDPVSGKYVPHLLQRLEYGGVIAISGYTGGPDFTASVFPFLRRQAAIIGIDSVWLDMETRREIWRRLAGPWKPSDEALRQIGHDITLDDLDSALKQILAGRMQGRAVVNL

SEQ ID NO: 835 - DNA, 1032 bp, Alicyclobacillus acidocaldarius
atgcgctcacgcccaccgaaggaggtacacgacatgaccacgtttcgcgcccacatggtggaacaggacggaaacgcacatcgcgccggcgtccgcgagctcaccctagaccaactgcccgaaggtgaggtgctcatccgcgtccgctactcgagcgtcaactacaaggacggaatctgttcccagcccgcgagccggctcgtgacgcgctaccccatggtgctcgggattgatctcgcaggcgaagtcgtcgaatcgcgggatgctcggtttcggccgggcgatcccgtcatctgcaccagctacgatctcggcacgggccacttcgggggcttcagcgaatacgcccgcgtgcctgccgactgggtggtcccgcttcccgacgggctgtcgctgcgcgacgccatggtgctcggcaccgccggattcaccgccgcactatccctgtaccgtatggagcaaaacggcgtgtctcccgccatgggcgccatgctcgtgacgggcgccaccggcggcgtcggcgcgaccggcatcgccatcgccaaacgggccgggtaccgcgtggtggcgtcgacgcgcaaggacgaggccgccgaatggctgaaaaccctcggcgcggacgacgtggtgcggcccgatgcgcttcttctgcaggaaggcgaatcctacctgaacgtgaagacgcgctatgcgggcgtgatcgatcccgtgtcgggcaaatacgtgccacacctgctgcagcgcctcgagtacggcggcgtcatcgccatcagcggttacacgggcgggccggatttcaccgccagcgtgttcccgttcctccgccgccaagcggccatcatcggcatcgactcggtgtggctcgacatggagacgcgccgcgagatctggcgccggctcgccgggccgtggaaaccgagcgatgaggcgctgaggcaaatcggccacgacatcacactggacgacctcgacagcgccctgaagcagatcctcgcgggccggatgcagggccgcgccgtcgtcaacctgtga

SEQ ID NO: 836 - protein, 327 aa, Geobacillus thermodenitrificans NG80-2
MPTFQAFVVNKTEAEFTAGVETLSMDDLPEGDVVVRVHYSSVNYKDGLASIPDGKIVKTYPFVPGIDLAGIVVSSNDARFREGDEVIATGYEIGVTHFGGYSEYARLHGDWLVPLPKGLTLREAMAIGTAGFTAALSIHRLEELGLVPERGPVLVTGATGGVGSLAVSMLAKRGYTVAASTGKATEHDYLRALGAKEVLTREDVTAERIRPLDKQRWAAAVDPVGGRTLATVLSRIRYGGAVAVSGLTGGVEVPTTVHPFILRGVSLLGIDSVYCPMDLRLRIWEQLASDLKPDLEQIVHEISLHELPGALARILRGELRGRTVVRL

SEQ ID NO: 837 - protein, 327 aa, Geobacillus kaustophilus HTA426
MSAFQAFVVNKTETEFTAGVQTISMDDLPEGDVVVRVHYSSVNYKDGLASIPDGKIVKTYPFVPGIDLAGVVVSSQHPRFREGDEVIATGYEIGVTHFGGYSEYARLHGDWLVPLPKGLTLKEAMAIGTAGFTAALSIHRLEEHGLTPERGPVLVTGATGGVGSLAVSMLSKRGYTVEASTGKTAEHDYLRALGAKEVLTREDVTAERIRPLDKQRWAAAVDPVGGRTLATVLSRIRYGGAVAVSGLTGGAEVPTTVHPFILRGVSLLGIDSVYCPMDVRLRIWERLAGDLKPDLERIAQEISLAELPQALKRILRGELRGRMVVRL

SEQ ID NO: 838 - protein, 326 aa, Bacillus sp. SG-1
TFKALVVNKTEEDFSVNIEPLTFEDLPQGDVTIRVHYSSVNYKDGLASIPNGKVVQSYPFVPGIDLAGVVTSSDDDRYKEGDKVIVTSYELGVSHYGGYSEYARVPGDWVVPLPDNLTLKEAMVFGTAGFTAALSIHQLENSGLRPENGPVLVTGATGGVGSMAVAMLAKRNYHVTASTGKESEHEYLKSLGAKEIVSREEVAPEKIRPIGKQRWAGAVDPVGGKTLASVLSNTKYGGAVAVSGLTGGADVPTTVFPFILRGVNLLGIDSVYCPKELRETLWNRMADDLKPDGLGEIENEVTLEELPRTLSAILQGKTRGRTVVKI

SEQ ID NO: 839 - protein, 328 aa, Bacillus subtilis subsp. subtilis str. 168
TLFQALQAEKNADDVSVHVKTISTEDLPKDGVLIKVAYSGINYKDGLAGKAGGNIVREYPLILGIDAAGTVVSSNDPRFAEGDEVIATSYELGVSRDGGLSEYASVPGDWLVPLPQNLSLKEAMVYGTAGFTAALSVHRLEQNGLSPEKGSVLVTGATGGVGGIAVSMLNKRGYDVVASTGNREAADYLKQLGASEVISREDVYDGTLKALSKQQWQGAVDPVGGKQLASLLSKIQYGGSVAVSGLTGGGEVPATVYPFILRGVSLLGIDSVYCPMDVRAAVWERMSSDLKPDQLLTIVDREVSLEETPGALKDILQNRIQGRVIVKL

SEQ ID NO: 840 - protein, 326 aa, Bacillus amyloliquefaciens FZB42
FKALVVDQREDRFSVSVRELAVQDLPEGEVLIKVCYSGVNYKDSLAAIPDGKIVTSYPFVPGIDLAGIVVSSDDARFKEGDKVIATSYGIGVSRFGGYSGMARIPADWIVPLPEGLTLKEAMTIGTAGFTAALSVQRLEENHAAPEKGKVLVTGATGGVGSFAVSILSTLGYEVEASTGKEDESGYLKSLGAKTVIHRDEVYNGTLKPMQKQKWAAAVDPVGGEPLASVLSQIQYGGSVAVSGLTAGTKLPATVFPFILRGVSLLGIDSVFCPMETRKKTWQRLADDFKPADLEAFIQKEITLEELPDTLPALLKGEARGRTIVTI

SEQ ID NO: 841 - protein, 343 aa, Artificial
  Substituion in SEQ ID NO 834
MRSRPPKEVHDMTTFRAHMVEQDGNAHRAGVRELTLDQLPEGEVLIRVRYSSVNYKDGICSQPASRLVTRYPMVLGIDLAGEVVESRDARFRPGDPVICTSYDLGTGHFGGFSEYARVPADWVVPLPDGLSLRDAMVLGTAGFTAALSLYRMEQNGVSPAMGAMLVTGATGGVGATGIAIAKRAGYRVVASTRKDEAAEWLKTLGADDVVRPDALLLQEGESYLNVKTRYAGVIDPVSGKYVPHLLQRLEYGGVIAISGYTGGPDFTASVFPFLRRQAAIIGIDSVWLDMETRREIWRRLAGPWKPSEEALRQIGHDITLDDLDSALKQILAGRMQGRAVVNL

SEQ ID NO: 842 - protein, 343 aa, Artificial
  Substituion in SEQ ID NO 834
MRSRPPKEVHEMTTFRAHMVEQDGNAHRAGVRELTLDQLPEGEVLIRVRYSSVNYKDGICSQPASRLVTRYPMVLGIDLAGEVVESRDARFRPGDPVICTSYDLGTGHFGGFSEYARVPADWVVPLPDGLSLRDAMVLGTAGFTAALSLYRMEQNGVSPAMGAMLVTGATGGVGATGIAIAKRAGYRVVASTRKDEAAEWLKTLGADDVVRPDALLLQEGESYLNVKTRYAGVIDPVSGKYVPHLLQRLEYGGVIAISGYTGGPDFTASVFPFLRRQAAIIGIDSVWLDMETRREIWRRLAGPWKPSDEALRQIGHDITLDDLDSALKQILAGRMQGRAVVNL

SEQ ID NO: 843 - protein, 343 aa, Artificial
  Substituion in SEQ ID NO 834
MRSRPPKEVHDMTTFRAHMVEQDGNAHRAGVRELTIDQLPEGEVLIRVRYSSVNYKDGICSQPASRLVTRYPMVLGIDLAGEVVESRDARFRPGDPVICTSYDLGTGHFGGFSEYARVPADWVVPLPDGLSLRDAMVLGTAGFTAALSLYRMEQNGVSPAMGAMLVTGATGGVGATGIAIAKRAGYRVVASTRKDEAAEWLKTLGADDVVRPDALLLQEGESYLNVKTRYAGVIDPVSGKYVPHLLQRLEYGGVIAISGYTGGPDFTASVFPFLRRQAAIIGIDSVWLDMETRREIWRRLAGPWKPSDEALRQIGHDITLDDLDSALKQILAGRMQGRAVVNL

SEQ ID NO: 844 - protein, 343 aa, Artificial
  Substituion in SEQ ID NO 834
MRSRPPKEVHDMTTFRAHMVEQDGNAHRAGVRELTLDQLPEGEVLIRVRYSSVNYKDGICSQPASRLVTRYPMVLGIDLAGEVVESRDARFRPGDPVICTSYDLGTGHFGGFSEYARVPADWVVPLPDGLSLRDAMVLGTAGFTAALSLYRMEQNGVSPAMGAMLVTGATGGVGATGIAIAKRAGYRVVASTRKDEAAEWLKTLGADDVVRPDALLLQEGESYLNVKTRYAGVIDPVSGKYVPHLLQRLEYGGVIAISGYTGGPDFTASVFPFLRRQAAIIGIDSVWLEMETRREIWRRLAGPWKPSDEALRQIGHDITLDDLDSALKQILAGRMQGRAVVNL

SEQ ID NO: 845 - protein, 343 aa, Artificial
  Substituion in SEQ ID NO 834
MRSRPPKEVHDMTTFRAHMVEQDGNAHRAGVRELTLDQLPEGEVLIRVRYSSVNYKDGICSQPASRLVTRYPMVLGIDLAGEVVESRDARFRPGDPVICTSYDLGTGHFGGFSEYARVPADWVVPLPDGLSLRDAMVLGTAGFTAALSLYRMEQNGVSPAMGAMLVTGATGGVGATGIAIAKRAGYRVVASTRKDEAAEWLKTLGADDVVRPDALLLQEGESYLNVKTRYAGVIDPVSGKYVPHLLQRLEYGGVIAISGYTGGPDFTASVFPFLRRQAAIIGIDSVWLDMETRREIWRRLAGPWKPSDEALRQIGHDITLEDLDSALKQILAGRMQGRAVVNL

SEQ ID NO: 846 - DNA, 1032 bp, Artificial
  Substituion in SEQ ID NO 835
atgcgctcacgcccaccgaaggaggtacacgacatgaccacgtttcgcgcccacatggtggaacaggacggaaacgcacatcgcgccggcgtccgcgagctcaccctagaccaactgcccgaaggtgaggtgctcatccgcgtccgctactcgagcgtcaactacaaggacggaatctgttcccagcccgcgagccggctcgtgacgcgctaccccatggtgctcgggattgatctcgcaggcgaagtcgtcgaatcgcgggatgctcggtttcggccgggcgatcccgtcatctgcaccagctacgatctcggcacgggccacttcgggggcttcagcgaatacgcccgcgtgcctgccgactgggtggtcccgcttcccgacgggctgtcgctgcgcgacgccatggtgctcggcaccgccggattcaccgccgcactatccctgtaccgtatggagcaaaacggcgtgtctcccgccatgggcgccatgctcgtgacgggcgccaccggcggcgtcggcgcgaccggcatcgccatcgccaaacgggccgggtaccgcgtggtggcgtcgacgcgcaaggacgaggccgccgaatggctgaaaaccctcggcgcggacgacgtggtgcggcccgatgcgcttcttctgcaggaaggcgaatcctacctgaacgtgaagacgcgctatgcgggcgtgatcgatcccgtgtcgggcaaatacgtgccacacctgctgcagcgcctcgagtacggcggcgtcatcgccatcagcggttacacgggcgggccggatttcaccgccagcgtgttcccgttcctccgccgccaagcggccatcatcggcatcgactcggtgtggctcgacatggagacgcgccgcgagatctggcgccggctcgccgggccgtggaaaccgagcgaagaggcgctgaggcaaatcggccacgacatcacactggacgacctcgacagcgccctgaagcagatcctcgcgggccggatgcagggccgcgccgtcgtcaacctgtga

SEQ ID NO: 847 - DNA, 1032 bp, Artificial
  Substituion in SEQ ID NO 835
atgcgctcacgcccaccgaaggaggtacacgaaatgaccacgtttcgcgcccacatggtggaacaggacggaaacgcacatcgcgccggcgtccgcgagctcaccctagaccaactgcccgaaggtgaggtgctcatccgcgtccgctactcgagcgtcaactacaaggacggaatctgttcccagcccgcgagccggctcgtgacgcgctaccccatggtgctcgggattgatctcgcaggcgaagtcgtcgaatcgcgggatgctcggtttcggccgggcgatcccgtcatctgcaccagctacgatctcggcacgggccacttcgggggcttcagcgaatacgcccgcgtgcctgccgactgggtggtcccgcttcccgacgggctgtcgctgcgcgacgccatggtgctcggcaccgccggattcaccgccgcactatccctgtaccgtatggagcaaaacggcgtgtctcccgccatgggcgccatgctcgtgacgggcgccaccggcggcgtcggcgcgaccggcatcgccatcgccaaacgggccgggtaccgcgtggtggcgtcgacgcgcaaggacgaggccgccgaatggctgaaaaccctcggcgcggacgacgtggtgcggcccgatgcgcttcttctgcaggaaggcgaatcctacctgaacgtgaagacgcgctatgcgggcgtgatcgatcccgtgtcgggcaaatacgtgccacacctgctgcagcgcctcgagtacggcggcgtcatcgccatcagcggttacacgggcgggccggatttcaccgccagcgtgttcccgttcctccgccgccaagcggccatcatcggcatcgactcggtgtggctcgacatggagacgcgccgcgagatctggcgccggctcgccgggccgtggaaaccgagcgatgaggcgctgaggcaaatcggccacgacatcacactggacgacctcgacagcgccctgaagcagatcctcgcgggccggatgcagggccgcgccgtcgtcaacctgtga

SEQ ID NO: 848 - DNA, 1032 bp, Artificial
  Substituion in SEQ ID NO 835
atgcgctcacgcccaccgaaggaggtacacgacatgaccacgtttcgcgcccacatggtggaacaggacggaaacgcacatcgcgccggcgtccgcgagctcaccattgaccaactgcccgaaggtgaggtgctcatccgcgtccgctactcgagcgtcaactacaaggacggaatctgttcccagcccgcgagccggctcgtgacgcgctaccccatggtgctcgggattgatctcgcaggcgaagtcgtcgaatcgcgggatgctcggtttcggccgggcgatcccgtcatctgcaccagctacgatctcggcacgggccacttcgggggcttcagcgaatacgcccgcgtgcctgccgactgggtggtcccgcttcccgacgggctgtcgctgcgcgacgccatggtgctcggcaccgccggattcaccgccgcactatccctgtaccgtatggagcaaaacggcgtgtctcccgccatgggcgccatgctcgtgacgggcgccaccggcggcgtcggcgcgaccggcatcgccatcgccaaacgggccgggtaccgcgtggtggcgtcgacgcgcaaggacgaggccgccgaatggctgaaaaccctcggcgcggacgacgtggtgcggcccgatgcgcttcttctgcaggaaggcgaatcctacctgaacgtgaagacgcgctatgcgggcgtgatcgatcccgtgtcgggcaaatacgtgccacacctgctgcagcgcctcgagtacggcggcgtcatcgccatcagcggttacacgggcgggccggatttcaccgccagcgtgttcccgttcctccgccgccaagcggccatcatcggcatcgactcggtgtggctcgacatggagacgcgccgcgagatctggcgccggctcgccgggccgtggaaaccgagcgatgaggcgctgaggcaaatcggccacgacatcacactggacgacctcgacagcgccctgaagcagatcctcgcgggccggatgcagggccgcgccgtcgtcaacctgtga

SEQ ID NO: 849 - DNA, 1032 bp, Artificial
  Substituion in SEQ ID NO 835
atgcgctcacgcccaccgaaggaggtacacgacatgaccacgtttcgcgcccacatggtggaacaggacggaaacgcacatcgcgccggcgtccgcgagctcaccctagaccaactgcccgaaggtgaggtgctcatccgcgtccgctactcgagcgtcaactacaaggacggaatctgttcccagcccgcgagccggctcgtgacgcgctaccccatggtgctcgggattgatctcgcaggcgaagtcgtcgaatcgcgggatgctcggtttcggccgggcgatcccgtcatctgcaccagctacgatctcggcacgggccacttcgggggcttcagcgaatacgcccgcgtgcctgccgactgggtggtcccgcttcccgacgggctgtcgctgcgcgacgccatggtgctcggcaccgccggattcaccgccgcactatccctgtaccgtatggagcaaaacggcgtgtctcccgccatgggcgccatgctcgtgacgggcgccaccggcggcgtcggcgcgaccggcatcgccatcgccaaacgggccgggtaccgcgtggtggcgtcgacgcgcaaggacgaggccgccgaatggctgaaaaccctcggcgcggacgacgtggtgcggcccgatgcgcttcttctgcaggaaggcgaatcctacctgaacgtgaagacgcgctatgcgggcgtgatcgatcccgtgtcgggcaaatacgtgccacacctgctgcagcgcctcgagtacggcggcgtcatcgccatcagcggttacacgggcgggccggatttcaccgccagcgtgttcccgttcctccgccgccaagcggccatcatcggcatcgactcggtgtggctcgaaatggagacgcgccgcgagatctggcgccggctcgccgggccgtggaaaccgagcgatgaggcgctgaggcaaatcggccacgacatcacactggacgacctcgacagcgccctgaagcagatcctcgcgggccggatgcagggccgcgccgtcgtcaacctgtga

SEQ ID NO: 850 - DNA, 1032 bp, Artificial
  Substituion in SEQ ID NO 835
atgcgctcacgcccaccgaaggaggtacacgacatgaccacgtttcgcgcccacatggtggaacaggacggaaacgcacatcgcgccggcgtccgcgagctcaccctagaccaactgcccgaaggtgaggtgctcatccgcgtccgctactcgagcgtcaactacaaggacggaatctgttcccagcccgcgagccggctcgtgacgcgctaccccatggtgctcgggattgatctcgcaggcgaagtcgtcgaatcgcgggatgctcggtttcggccgggcgatcccgtcatctgcaccagctacgatctcggcacgggccacttcgggggcttcagcgaatacgcccgcgtgcctgccgactgggtggtcccgcttcccgacgggctgtcgctgcgcgacgccatggtgctcggcaccgccggattcaccgccgcactatccctgtaccgtatggagcaaaacggcgtgtctcccgccatgggcgccatgctcgtgacgggcgccaccggcggcgtcggcgcgaccggcatcgccatcgccaaacgggccgggtaccgcgtggtggcgtcgacgcgcaaggacgaggccgccgaatggctgaaaaccctcggcgcggacgacgtggtgcggcccgatgcgcttcttctgcaggaaggcgaatcctacctgaacgtgaagacgcgctatgcgggcgtgatcgatcccgtgtcgggcaaatacgtgccacacctgctgcagcgcctcgagtacggcggcgtcatcgccatcagcggttacacgggcgggccggatttcaccgccagcgtgttcccgttcctccgccgccaagcggccatcatcggcatcgactcggtgtggctcgacatggagacgcgccgcgagatctggcgccggctcgccgggccgtggaaaccgagcgatgaggcgctgaggcaaatcggccacgacatcacactggaagacctcgacagcgccctgaagcagatcctcgcgggccggatgcagggccgcgccgtcgtcaacctgtga

SEQ ID NO: 851 - protein, 994 aa, Alicyclobacillus acidocaldarius
MIDIRTEAQAEARTVQLEIDGKEVTVERGASVLDAILSTGQEHPHVCYHPALGPIETCDTCIVEIDGKLMRACSTPVEDGMAVRTKSVAARYARKEAMDRILKNHELYCTVCDNNNGNCVLHNTVMQMGVEHQAYPFTPKPYEVDMSNPFYRYDPQQCILCGRCVEACQNLQVSEVLSIAWDREVPRVIWDNDVPINESSCVSCGHCVTVCPTNALMEKSMLGEAGFLTGIEKPTLDKMIDITKKVEPGYSSIFVVSEIEHEMREARIRKTKTVCTYCGVGCAFDVWTKDRHILKVEPQMEAPVNQISTCVKGKFGWDFVNSPDRLTKPLVRKGDRFVEVSWDEALDVIERRIKEIQAKHGYDAVAFISSSKTTNEENYLMQKLARAVMHTNNIDNCSRYCQSPATEALRRTMGLGGDTGSIKDLELADLVLIVGANPAEAHPVLSTRLRRAQKKRGQKHIVADVRRNIMATRADLFIQPRQGTDLVWLSAVTKYIIDQGRHDEAFLRDRVNGFDEYVQSLEKFTLDYASEICGLRKEELVRVAEMIMEAKRVAVCWAMGVTQHRGGSDTSTAICNLLLVTGNVARPGTGAYPLRGHNNVQGAGDMGCAPPFLPGYERVDNEEQRRKWEKLWGVELPTTPGLNNHQMVDAIHEGKLKAMYLCGEDMAVVDSNANYVEDAFRKLEFFVVQDVFLSKTAQFADVVLPACPSLEKEGTFTNTERRIQRLYRVLEPLGDAKPDWEIIQMVANRFGAHWNYTSAREIFEEMASAADLFRGASYDRLEGYGSLQWPVLPDGTDTPLLYTDGFAFPDKKARLYPVDWTPPIEVGEEYDLELNNGRLLEHFHEGNMTSRVPGIHEKVPETFVEISPELAKERGVQDGALVRLVSPYGSIKVRVAVTDRVSGKHVYVPLLSHADEEAVNRLTSSDHDTATYTPAYKEMRVRMEVIQSCGEPPIKRGNFRLGKPNPQPGVNVEQKWARKDYVPLVTDRALVKEG

SEQ ID NO: 852 - DNA, 2985 bp, Alicyclobacillus acidocaldarius
atgatcgatatcaggaccgaagcacaggccgaggcgcggaccgtgcaactcgagatcgacggcaaggaagtcaccgtggaacgaggtgcgtcggtgctcgacgccattctgtccacgggccaggaacatccgcacgtctgttatcatccggcgctcggccccattgaaacgtgcgacacctgcattgtcgagatcgacggcaagctgatgcgcgcgtgttccacacctgtcgaggacgggatggcggtccggaccaagtccgtggccgcgcggtatgcccgcaaagaggcgatggaccgcattctgaagaaccacgagctgtactgcaccgtgtgcgacaacaacaacggcaactgcgtgctgcacaacaccgtgatgcagatgggcgtggaacatcaggcgtatccgttcacgcccaagccgtacgaggtcgacatgtcgaacccgttttatcggtacgatccgcagcagtgcatcctttgcggccgctgcgtcgaggcgtgccaaaacctgcaggtgagcgaggttctctccatcgcgtgggatcgcgaggtgccgcgggtcatctgggacaacgacgtgcccatcaacgagtcgtcgtgtgtgtcgtgtggccactgcgtgacggtctgtccgaccaacgcgctcatggaaaaatccatgcttggggaagcgggcttcctcacgggcatcgaaaagccgaccctggataagatgatcgacatcaccaagaaggtcgagcccggttactcgtccatctttgtcgtctcggagattgagcacgagatgcgcgaagcgcgcattcggaagacgaagacggtctgcacgtattgcggcgtgggctgcgcgttcgacgtgtggacgaaggatcggcacattttaaaggtcgagccgcagatggaggcgccggtcaaccagatctccacgtgcgtcaagggcaagttcggctgggactttgtgaacagcccggatcgcctgaccaagcctctggtgcgcaagggcgatcggttcgtggaagtgagctgggacgaggcgctcgacgtgatcgaacggcgcatcaaggagatccaggcgaagcacgggtacgacgcggtggcgttcatctcgtcgtccaagacgaccaacgaagaaaactacctgatgcagaagctggcgcgcgccgtcatgcacacgaacaacatcgacaactgctcgcgttactgccagtctcctgcgaccgaggcgctgcggcggaccatggggctcggcggcgacaccggatctatcaaggatctggagctggccgatctcgtcctcatcgtcggcgcgaaccctgccgaggcgcatcccgtgttgtcgacgcgcctgcgccgggcgcagaagaagcgcggccagaagcacatcgtggccgacgtgcggcgcaacatcatggcgacacgcgccgatctcttcatccagccgcgccagggcacggacttggtctggttgtccgcggtgacgaagtacatcatcgatcagggccggcacgacgaggcattcctgcgggatcgcgtgaatggctttgacgaatacgtgcagtcgctcgagaagttcacgctggactacgcgagcgagatctgcggcctccgcaaagaggagctcgtccgcgtggccgagatgatcatggaggcaaagcgcgtcgcggtctgctgggccatgggcgtgacgcagcaccggggtggcagtgacacgtcgaccgccatctgcaacttgcttttggtgaccgggaacgtggcgcggccgggcacgggtgcgtatccgctgcgcggtcacaacaacgtgcagggagccggtgacatgggctgcgcgcctccgttcctgccgggctacgagcgcgtggacaacgaagagcagcggcgcaagtgggagaagctctggggcgtcgaactgccgaccacgcctgggctcaacaatcatcagatggtggatgccattcacgaaggcaagctgaaggcgatgtacctctgcggggaggacatggcggtggtggactccaacgccaactacgtggaggacgccttccggaaactcgagttcttcgtggtccaggacgtcttcctgtccaagaccgcgcagttcgcggacgtggtccttccggcctgcccgagccttgagaaggagggcacgttcacgaacaccgagcggcgcatccagcgcttgtatcgggtgcttgaaccgctgggagacgcgaagccggactgggagatcattcaaatggtcgccaaccggtttggcgcccattggaactacacatctgcgcgcgagattttcgaggagatggcgagtgcggccgatctgttccggggggcgtcgtacgaccgcctcgagggctacgggagcctgcagtggcccgtgcttcccgacggcaccgacacgccgctcctgtacacggacggcttcgcattccccgacaagaaggcgcggctctatccggtcgactggacgccgcccatcgaagtcggggaggaatacgatctagagttgaacaacgggcgcttgctcgagcacttccacgagggcaacatgacgagccgcgtgcccggtatccacgaaaaagtgccggaaaccttcgtcgagatctcgccggagctcgcgaaggagcgcggtgtccaggacggcgcgctggtgcgcctcgtctcgccgtacggcagcatcaaggtgcgcgtggccgtgacggatcgcgtgtccgggaaacacgtgtacgttccgctcttgtcccatgcggacgaggaggcggtcaaccgcctcacgtcgagcgatcacgacaccgccacctacacgcctgcctataaggaaatgcgcgtgcgcatggaggtcatccaatcgtgtggcgagccgcccatcaagcgcgggaacttccgcctgggcaagccgaacccgcagcccggtgtgaacgtcgagcaaaagtgggcgcgcaaggactacgtgccgctggtgacggatcgcgcgcttgtgaaggagggttga

SEQ ID NO: 853 - protein, 974 aa, Bacillus coagulans 36D1
EEATFSIRINGQELAARKGQTILEVANAHDMYIPAICYHPNLGSIQTCDTCFVNVNGNLVRACATKVEPGMEVESGSKPVKDAQYEAMSRILKNHELYCTVCDNNNGNCVVHNTAEHLEIEHQKYQFEAKPYPPDQSHPFYRYEPDQCILCGRCVEACQDLQVNETLTIDWDREVPRVIWDNDVPIDESSCVSCGHCVTVCPCNALMEKSMLGEAGYLTGIPQKVLEPMIDLTKEVEPGYKEIFAISEMEAAMRKSRIKRTKTVCTYCGVGCSFEIWTKGRHILKVEPQEHAPVNGISTCVKGKFGWDFVNSEERLTKPLIRKGEEFVEASWDEALNLIASKLQEIKKQHGPDALGFIASSKCSNEENYLFQKFARAIIGTNNLDNCSRYCQSPATSGLLRTVGIGGDSGTIRDIQQADLVVTVGANPAESHPVLATRIKRAHKLHGQKLMVVDLRENELASRANLFIHSKPSTDLIWLNAVTKYILDQGWEDKAFLEARVKGLDKFRASLEKYTLAFAEEKTGISKENLIKMATMIHEAKSVCILWAMGITQHTCGTDASTAISNLLLVTGNYGRPGTGAYPLRGHNNVQGACDFGTMPAWFPGYEPVEDNEVRERYEKAWGVKLPENPGLDNHQMIGGIKSGKLRGLYLFGEEMAIVDSNINFVEEHLEKLDFFVVQDVFFSKTAQFADVILPAAPSLEKEGTFTNTERRIQRFYQVFEPMGESKPDWVIFQELANKMGAQWHYQHPGEIMAEAASLAKYFAGISYERLEGFNSQIWPVKKDGTSTPLLYQDRFAFPDGKARLVPVDWEPPFSAGEGFDYHLNNGRLLEQFHEGNLTDRSPGIHHKVPEPWLEISPEAASERGIKDGALVRLTSPYGKVKVRAVVTGRVQGKELYLTMNARKEDEMVNRLTSSYHDRVTHTPNYKEMGVKMEILEEKGKPPLPKVNHRYGNRIPQISVRVEEKWKRDDFIPI

SEQ ID NO: 854 - protein, 985 aa, Geobacillus kaustophilus HTA426
EAQMVTVTINGRAYRAKPGMTILEVVNEHGLPHPQVCYTPELGAIQTCDTCIAEVNGTLLRACATPVEDGMVVELGSPRAKAAQKEAMDRLLENHLLYCTVCDNNNGNCKLHNTAEMMQIEHQTYPYRPKVDPSEVDMSHPFYRYDPNQCIACGQCVEACQNLQVNETLSIDWEAERPRVVWDGGVPINESSCVSCGQCVTVCPCNALMEKSMLGEAGFLTGLDKDVLNPMIDFVKEVEPNYTSIFAISEIEAAMREQRIKKTKTVCTFCGVGCSFEVWTKGRKILKIQPVSEAPVNAISTCVKGKFGWDFVNSEERLTKPLIRKGDVFVESTWDEALDLVAEKLGAIKRQYGGNAIGFISSSKISNEENYLMQKLARQVFETNNVDNCSRYCQSPATDGLFRTVGMGGDSGTIHDIATAGLVIIIGANPAEGHPVLATRVKRAHKLFGQKLIVADLRRNEMAERADLFIRPKQGTDQVWLMAVTKYIIDQGWHDEAFIRERVHFFEEFKQLLEKYTLDYAEQVTGIAKADLIRIAEMIHEADGTCVLWGMGVTQNTGGSDTSAAISNLLLATGNYGRPGAGAFPLRGHNNVQGACDMGSLPAWLPGYQHVTDDEARAKFEQAYGVRIDAKPGLDNIQMLEAAERGELKAMYIVGEDMALVDCNANHVQETLAKLDFVVVQDIFLSKTAQFADVILPAAPSLEKEGTFTNTERRIQRFYQALEPLGDSKPDWWIIQEIAKRLGADWNYAGPKEIMDEIASLAPLYSQAHYDRLEGWNSLCWGSHDGADTPLLYKERFNFPDGKARFALADWVEPVQYPEEYDLLVNNGRLLEHFHEGNLTYKSKGIEHKFPEVFVEVSPELAKERGIEDGALVRLISPYGRVKVRVLVTDRVRGNELFLPMHSTANESAINILTGPATDRRTNTPAYKQARVRMEVIERSGKTPLPRTNPRFKKRHPQNGVEVERKWRRSDYVPLTEENKGVTIG

SEQ ID NO: 855 - protein, 970 aa, Bacillus sp. NRRL B-14911
TYQVKLNGAEVKVAAGDETTILQLLQNSSVEVPNVCYHPSLGPIETCDTCIVSVNGELVRSCSTKLNDGDIIDTVSADVKEAQVIGMDRILTNHELYCTVCDYNNGGCEVHNTVKEMKINHQSVPFAQKPYPADNSHPFYRYDPDQCILCGRCVEACQDVQVTETLTIDWEREKPRVIWDNDVPINESSCVSCGHCSTVCPCNAMLEKGMEGEAGYLTGIAKQTLRPMIEITKNVETGYGSILAISDMEAAMRDERIKKTKTVCTYCGVGCSFDVWTKGREILKVDPQPEAPANGISTCVKGKFGWDFVNSEERLTKPLIREGEFFREAEWDEAISLIARRFTEIKNEHGAQAMSFISSSKCTNEESFLMQKLGRAVIGTNNIDNCSRYCQTPATVGLFRTVGYGGDAGSIRDIQMSDLVLIIGSNTAESHPVLSTRVKRSHKLGGQKLIVADLRKHEMADRADLFVQPKAGTDIVWLSAVAKYIIDNGMADEEFLAEKVNGLDEFTKNLEKYTMEYAAEVTGIALEQLIDMAEMIGRAKSVCALWAMGITQHMGGSDASTAISNLLLVTGNYAKPGAGAYPLRGHNNVQGASDFGSMPNMFPGYQEVADPEIRKKYELAWGTELPGEPGLNNHEMVEGIHAGTLKAMYLKGEDMGLVDSNINHVHAAFEKLDFFVVQDIFLSKTAEFADVVLPASPSLEKEGTFTNTERRIQRLYQALEPLGDSKPDWQIIMEIANSLGAGWNYTHPSEIMEEASRLMPLYSGVTYERLEGYNSLQWPVAEDGQDTPLLYTERFPFEDGRARLVPVDWTKPLEFEEEYDLHINNGRLLEHFHEGNMTYRSKGISEKTPSVFLEVSPELAEERGLESGTLVRLSSPYGNVKVQCHITDRVKGKEVYLPMNDRGEAAINLLTSSYADKDTDTPAYKEIRAKMEILKAKGEDPLPRINHRYGNPQPQIGVQVQKKWARKDYI

SEQ ID NO: 856 - protein, 985 aa, Geobacillus thermodenitrificans NG80-2
ETRTVTVTINGRPYHVKQGMTILETVNEHGLPHPQVCYTPELGAIQTCDTCIAEVNGTLLRACSTLVEDGMVVELSSPRAKVVQKEAMDRLLENHLLYCTVCDNNNGNCKLHNTTEMMQIEHQTYPYRPKVDPSEVDMSHPFYRYDPNQCIACGQCVEACQNLQVNETLSIDWEAERPRVVWDGGVPINESSCVSCGHCVTVCPCNALMEKSMLGEAGFMTGLDQDVLKPMIDFVKEVEPNYTSIFAISEIEAAMRQQRIKKTKTVCTFCGVGCSFEVWTKGRKILKIQPVSEAPVNAISTCVKGKFGWDFINSEERLTKPLIRKGDTFVESTWEEALDLVAEKLGAIKQQYGGNAIGFISSSKISNEENYLMQKLARQVFETNNVDNCSRYCQSPATDGLFRTVGMGGDSGTIYDIASAGLVIIIGANPAEGHPVIATRVKRAHKLFGQKLIVADLRRNEMAERADLFIRPKQGTDQVWLMAVTKYIIDQGWHDESFIRERVHFFDEFKQLLEKYTLDYAEQITGIAKTDLIRIAEMIHEADGTCVLWGMGVTQNTGGSDTSAAISNLLLATGNYGRPGAGAFPLRGHNNVQGACDMGSLPSWLPGYQHVTDDAARTKFEKVYGVRIDAKPGLDNIQMIEAAERGDLKAMYIIGEDMALVDCNANHVQDTLAKLDFVVVQDIFLSKTAQFADVILPAAPSLEKEGTFTNTERRIQRFYQALEPLGDSKPDWWIIQEIAKRLGADWNYAGPSEIMDEIASLAPLYSQAHYDRLEGWNSLCWGSYDGADTPLLYKERFNFPDGKARFALADWVEPVQYPEEYDLLVNNGRLLEHFHEGNLTYKSKGIQRKFPDIFVEVSPELAKERGISDGALVRLISPYGRVKVRVLVTDRVRGNELFLPMHSTANESAINILTGPQTDHRTNTPAYKQARVRMEVLERSGETPLPCTNPRFQKRHPQNGVEVERKWRRRDYVPLTEAEKEVKIG

SEQ ID NO: 857 - protein, 975 aa, Bacillus coagulans 36D1
ETKSIHITIDGRDYEARPGEKIIDVINRNDIFHPQICYYPEVDPIQTCDTCIAEVNGELMRTCSTVAEDGMVVRLSDDRSEAARHEAMDRILANHLLYCTVCDNNNGNCIVHNTTEKMGIEHQKYPFTPKTDASGVDYSNPFYRYDPNQCIACGRCVEACQNLQVNETLSIDWEAERPRVIWDNGVPINESSCVSCGHCVTVCPCNALMEKSMLGEAGYLTGLEEDLLDPMIDLVKKVEPGYGSIFAISEIEASMREQRTKKTKTVCTFCGVGCTFEVWTKGRKILKIEPKHEGPVNAISTCIKGKFGWDFVNSDKRLTKPLVRKDGKFVETSWDEALSVVASRLKEIHSQYGKDAVGFISSSKVTNEENYLMQKLARQVFETNNVDNCSRYCQSPATDGLLRTVGMGGDSGTIKDIASAGLVIIVGANPAEAHPVLATRIKRAHKLHGQKLIVADMRKNEMAERADLFIHPNQGTDQVWLMAVTKYIIDQGWHDENFIAEKVNFFDEFKETLEKYTLDYAEKMTGIPKETLIQIAEMIHQADGTCILWGMGVTQNTGGSDTSAAISNLLLATGNYTRPGTGAYPLRGHNNVQGACDMGTLPGWLPGYQHVEDDAAREKFEKAYGVKISNKPGLNNIEMLHAIAAGQLKAMYIIGEDMALVDSDANHVSEELSNLDFLVVQDVFFSKTAQYADVILPAAPSLEKEGTFTNTERRVQRLYQALPALGESKPDWWIIQEVAKRLGADWNYSHPGEIFAEMASLTPLFAQADYDKLEGWNSFLWGSLDGANTPLLYKDGFPFPDGKARFALTDWVKPAEFPEQYDLHINNGRMLEQFHEGNLTNKSEGIESKVPGVFVEVSPELAKERNLDTGDLVRVTSPFGSLQLHVLVTDRVQGKELYLPMHSTEKESAINFLTGPIYDKRQSTPAFKQTKVKMELIRKGGESPLPKSNHRDKKRNPTRGVEVERKWQREGYQPL

SEQ ID NO: 858 - protein, 994 aa, Artificial
  Substituion in SEQ ID NO 851
MIDIRTEAQAEARTVQLEIDGKEVTVERGASVLDAILSTGQEHPHVCYHPALGPIETCDTCIVEIDGKLMRACSTPVEDGMAVRTKSVAARYARKEAMDRILKNHELYCTVCDNNNGNCVLHNTVMQMGVEHQAYPFTPKPYEVDMSNPFYRYDPQQCILCGRCVEACQNLQVSEVLSIAWDREVPRVIWDNDVPINESSCVSCGHCVTVCPTNALMEKSMLGEAGFLTGIEKPTLDKMIDITKKVEPGYSSIFVVSEIEHEMREARIRKTKTVCTYCGVGCAFDVWTKDRHILKVEPQMEAPVNQISTCVKGKFGWDFVNSPDRLTKPLVRKGDRFVEVSWDEALDVIERRIKEIQAKHGYDAVAFISSSKTTNEENYLMQKLARAVMHTNNIDNCSRYCQSPATEALRRTMGLGGDTGSIKDLELADLVLIVGANPAEAHPVLSTRLRRAQKKRGQKHIVADVRRNIMATRADLFIQPRQGTDLVWLSAVTKYIIDQGRHDEAFLRDRVNGFDEYVQSLEKFTLDYASEICGLKKEELVRVAEMIMEAKRVAVCWAMGVTQHRGGSDTSTAICNLLLVTGNVARPGTGAYPLRGHNNVQGAGDMGCAPPFLPGYERVDNEEQRRKWEKLWGVELPTTPGLNNHQMVDAIHEGKLKAMYLCGEDMAVVDSNANYVEDAFRKLEFFVVQDVFLSKTAQFADVVLPACPSLEKEGTFTNTERRIQRLYRVLEPLGDAKPDWEIIQMVANRFGAHWNYTSAREIFEEMASAADLFRGASYDRLEGYGSLQWPVLPDGTDTPLLYTDGFAFPDKKARLYPVDWTPPIEVGEEYDLELNNGRLLEHFHEGNMTSRVPGIHEKVPETFVEISPELAKERGVQDGALVRLVSPYGSIKVRVAVTDRVSGKHVYVPLLSHADEEAVNRLTSSDHDTATYTPAYKEMRVRMEVIQSCGEPPIKRGNFRLGKPNPQPGVNVEQKWARKDYVPLVTDRALVKEG

SEQ ID NO: 859 - protein, 994 aa, Artificial
  Substituion in SEQ ID NO 851
MIDIRTEAQAEARTVQLEIDGKEVTVERGASVLDAILSTGQEHPHVCYHPALGPIETCDTCIVEIDGKLMRACSTPVEDGMAVRTKSVAARYARKEAMDRILKNHELYCTVCDNNNGNCVLHNTVMQMGVEHQAYPFTPKPYEVDMSNPFYRYDPQQCILCGRCVEACQNLQVSEVLSIAWDREVPRVIWDNDVPINESSCVSCGHCVTVCPTNALMEKSMLGEAGFLTGIEKPTLDKMIDITKKVEPGYSSIFVVSEIEHEMREARIRKTKTVCTYCGVGCAFDVWTKDRHILKVEPQMEAPVNQISTCVKGKFGWDFVNSPDRLTKPLVRKGDRFVEVSWDEALDVIERRIKEIQAKHGYDAVAFISSSKTTNEENYLMQKLARAVMHTNNIDNCSRYCQSPATEALRRTMGLGGDTGSIKDLELADLVLIVGANPAEAHPVLSTRLRRAQKKRGQKHIVADVRRNIMATRADLFIQPRQGTDLVWLSAVTKYIIDQGRHDEAFLRDRVNGFDEYVQSLEKFTLDYASEICGLRKEELVRVAEMIMEAKRVAVCWAMGVTQHRGGSDTSTAICNLLLVTGNVARPGTGAYPLRGHNNVQGAGDMGCAPPFLPGYERVDNEEQRRKWEKLWGVELPTTPGLNNHQMVDAIHEGKLKAMYLCGEDMAVVDSNANYVEDAFRKLEFFVVQDVFLSKTAQFADVVLPACPSLEKEGTFTNTERRIQRLYRVLEPLGDAKPDWEIIQMVANRFGAHWNYTSAREIFEEMASAADLFRGASYDRLEGYGSLQWPVLPDGTDTPLLYTDGFAFPDKKARLYPVDWTPPIEVGEEYDLELNNGRLLEHFHEGNMTSRVPGIHEKVPETFVEISPELAKERGVQDGALVRLVSPYGSIKVRVAVTDRVSGKHVYVPLLSHADEEAVNRLTSSDHDTATYTPAYKEMRVRMEVIQSCGEPPIKRGNFRLGKPNPQPGVNVEQKWARKDYVPLVTDRALVKDG

SEQ ID NO: 860 - protein, 994 aa, Artificial
  Substituion in SEQ ID NO 851
MIDIRTEAQAEARTVQLEIDGKEVTVERGASVLDAILSTGQEHPHVCYHPALGPIETCDTCIVEIDGKLMRACSTPVEDGMAVRTKSVAARYARKEAMDRILKNHELYCTVCDNNNGNCVLHNTVMQMGVEHQAYPFTPKPYEVDMSNPFYRYDPQQCILCGRCVEACQNLQVSEVLSIAWDREVPRVIWDNDVPINESSCVSCGHCVTVCPTNALMEKSMLGEAGFLTGIEKPTLDKMIDITKKVEPGYSSIFVVSEIEHEMREARIRKTKTVCTYCGVGCAFDVWTKDRHILKVEPQMEAPVNQISTCVKGKFGWDFVNSPDRLTKPLVRKGDRFIEVSWDEALDVIERRIKEIQAKHGYDAVAFISSSKTTNEENYLMQKLARAVMHTNNIDNCSRYCQSPATEALRRTMGLGGDTGSIKDLELADLVLIVGANPAEAHPVLSTRLRRAQKKRGQKHIVADVRRNIMATRADLFIQPRQGTDLVWLSAVTKYIIDQGRHDEAFLRDRVNGFDEYVQSLEKFTLDYASEICGLRKEELVRVAEMIMEAKRVAVCWAMGVTQHRGGSDTSTAICNLLLVTGNVARPGTGAYPLRGHNNVQGAGDMGCAPPFLPGYERVDNEEQRRKWEKLWGVELPTTPGLNNHQMVDAIHEGKLKAMYLCGEDMAVVDSNANYVEDAFRKLEFFVVQDVFLSKTAQFADVVLPACPSLEKEGTFTNTERRIQRLYRVLEPLGDAKPDWEIIQMVANRFGAHWNYTSAREIFEEMASAADLFRGASYDRLEGYGSLQWPVLPDGTDTPLLYTDGFAFPDKKARLYPVDWTPPIEVGEEYDLELNNGRLLEHFHEGNMTSRVPGIHEKVPETFVEISPELAKERGVQDGALVRLVSPYGSIKVRVAVTDRVSGKHVYVPLLSHADEEAVNRLTSSDHDTATYTPAYKEMRVRMEVIQSCGEPPIKRGNFRLGKPNPQPGVNVEQKWARKDYVPLVTDRALVKEG

SEQ ID NO: 861 - protein, 994 aa, Artificial
  Substituion in SEQ ID NO 851
MIDIRTEAQAEARTVQLEIDGKDVTVERGASVLDAILSTGQEHPHVCYHPALGPIETCDTCIVEIDGKLMRACSTPVEDGMAVRTKSVAARYARKEAMDRILKNHELYCTVCDNNNGNCVLHNTVMQMGVEHQAYPFTPKPYEVDMSNPFYRYDPQQCILCGRCVEACQNLQVSEVLSIAWDREVPRVIWDNDVPINESSCVSCGHCVTVCPTNALMEKSMLGEAGFLTGIEKPTLDKMIDITKKVEPGYSSIFVVSEIEHEMREARIRKTKTVCTYCGVGCAFDVWTKDRHILKVEPQMEAPVNQISTCVKGKFGWDFVNSPDRLTKPLVRKGDRFVEVSWDEALDVIERRIKEIQAKHGYDAVAFISSSKTTNEENYLMQKLARAVMHTNNIDNCSRYCQSPATEALRRTMGLGGDTGSIKDLELADLVLIVGANPAEAHPVLSTRLRRAQKKRGQKHIVADVRRNIMATRADLFIQPRQGTDLVWLSAVTKYIIDQGRHDEAFLRDRVNGFDEYVQSLEKFTLDYASEICGLRKEELVRVAEMIMEAKRVAVCWAMGVTQHRGGSDTSTAICNLLLVTGNVARPGTGAYPLRGHNNVQGAGDMGCAPPFLPGYERVDNEEQRRKWEKLWGVELPTTPGLNNHQMVDAIHEGKLKAMYLCGEDMAVVDSNANYVEDAFRKLEFFVVQDVFLSKTAQFADVVLPACPSLEKEGTFTNTERRIQRLYRVLEPLGDAKPDWEIIQMVANRFGAHWNYTSAREIFEEMASAADLFRGASYDRLEGYGSLQWPVLPDGTDTPLLYTDGFAFPDKKARLYPVDWTPPIEVGEEYDLELNNGRLLEHFHEGNMTSRVPGIHEKVPETFVEISPELAKERGVQDGALVRLVSPYGSIKVRVAVTDRVSGKHVYVPLLSHADEEAVNRLTSSDHDTATYTPAYKEMRVRMEVIQSCGEPPIKRGNFRLGKPNPQPGVNVEQKWARKDYVPLVTDRALVKEG

SEQ ID NO: 862 - protein, 994 aa, Artificial
  Substituion in SEQ ID NO 851
MIDIRTEAQAEARTVQLEIDGKEVTVERGASVLDAILSTGQEHPHVCYHPALGPIETCDTCIVEIDGKLMRACSTPIEDGMAVRTKSVAARYARKEAMDRILKNHELYCTVCDNNNGNCVLHNTVMQMGVEHQAYPFTPKPYEVDMSNPFYRYDPQQCILCGRCVEACQNLQVSEVLSIAWDREVPRVIWDNDVPINESSCVSCGHCVTVCPTNALMEKSMLGEAGFLTGIEKPTLDKMIDITKKVEPGYSSIFVVSEIEHEMREARIRKTKTVCTYCGVGCAFDVWTKDRHILKVEPQMEAPVNQISTCVKGKFGWDFVNSPDRLTKPLVRKGDRFVEVSWDEALDVIERRIKEIQAKHGYDAVAFISSSKTTNEENYLMQKLARAVMHTNNIDNCSRYCQSPATEALRRTMGLGGDTGSIKDLELADLVLIVGANPAEAHPVLSTRLRRAQKKRGQKHIVADVRRNIMATRADLFIQPRQGTDLVWLSAVTKYIIDQGRHDEAFLRDRVNGFDEYVQSLEKFTLDYASEICGLRKEELVRVAEMIMEAKRVAVCWAMGVTQHRGGSDTSTAICNLLLVTGNVARPGTGAYPLRGHNNVQGAGDMGCAPPFLPGYERVDNEEQRRKWEKLWGVELPTTPGLNNHQMVDAIHEGKLKAMYLCGEDMAVVDSNANYVEDAFRKLEFFVVQDVFLSKTAQFADVVLPACPSLEKEGTFTNTERRIQRLYRVLEPLGDAKPDWEIIQMVANRFGAHWNYTSAREIFEEMASAADLFRGASYDRLEGYGSLQWPVLPDGTDTPLLYTDGFAFPDKKARLYPVDWTPPIEVGEEYDLELNNGRLLEHFHEGNMTSRVPGIHEKVPETFVEISPELAKERGVQDGALVRLVSPYGSIKVRVAVTDRVSGKHVYVPLLSHADEEAVNRLTSSDHDTATYTPAYKEMRVRMEVIQSCGEPPIKRGNFRLGKPNPQPGVNVEQKWARKDYVPLVTDRALVKEG

SEQ ID NO: 863 - DNA, 2985 bp, Artificial
  Substituion in SEQ ID NO 852
atgatcgatatcaggaccgaagcacaggccgaggcgcggaccgtgcaactcgagatcgacggcaaggaagtcaccgtggaacgaggtgcgtcggtgctcgacgccattctgtccacgggccaggaacatccgcacgtctgttatcatccggcgctcggccccattgaaacgtgcgacacctgcattgtcgagatcgacggcaagctgatgcgcgcgtgttccacacctgtcgaggacgggatggcggtccggaccaagtccgtggccgcgcggtatgcccgcaaagaggcgatggaccgcattctgaagaaccacgagctgtactgcaccgtgtgcgacaacaacaacggcaactgcgtgctgcacaacaccgtgatgcagatgggcgtggaacatcaggcgtatccgttcacgcccaagccgtacgaggtcgacatgtcgaacccgttttatcggtacgatccgcagcagtgcatcctttgcggccgctgcgtcgaggcgtgccaaaacctgcaggtgagcgaggttctctccatcgcgtgggatcgcgaggtgccgcgggtcatctgggacaacgacgtgcccatcaacgagtcgtcgtgtgtgtcgtgtggccactgcgtgacggtctgtccgaccaacgcgctcatggaaaaatccatgcttggggaagcgggcttcctcacgggcatcgaaaagccgaccctggataagatgatcgacatcaccaagaaggtcgagcccggttactcgtccatctttgtcgtctcggagattgagcacgagatgcgcgaagcgcgcattcggaagacgaagacggtctgcacgtattgcggcgtgggctgcgcgttcgacgtgtggacgaaggatcggcacattttaaaggtcgagccgcagatggaggcgccggtcaaccagatctccacgtgcgtcaagggcaagttcggctgggactttgtgaacagcccggatcgcctgaccaagcctctggtgcgcaagggcgatcggttcgtggaagtgagctgggacgaggcgctcgacgtgatcgaacggcgcatcaaggagatccaggcgaagcacgggtacgacgcggtggcgttcatctcgtcgtccaagacgaccaacgaagaaaactacctgatgcagaagctggcgcgcgccgtcatgcacacgaacaacatcgacaactgctcgcgttactgccagtctcctgcgaccgaggcgctgcggcggaccatggggctcggcggcgacaccggatctatcaaggatctggagctggccgatctcgtcctcatcgtcggcgcgaaccctgccgaggcgcatcccgtgttgtcgacgcgcctgcgccgggcgcagaagaagcgcggccagaagcacatcgtggccgacgtgcggcgcaacatcatggcgacacgcgccgatctcttcatccagccgcgccagggcacggacttggtctggttgtccgcggtgacgaagtacatcatcgatcagggccggcacgacgaggcattcctgcgggatcgcgtgaatggctttgacgaatacgtgcagtcgctcgagaagttcacgctggactacgcgagcgagatctgcggcctcaaaaaagaggagctcgtccgcgtggccgagatgatcatggaggcaaagcgcgtcgcggtctgctgggccatgggcgtgacgcagcaccggggtggcagtgacacgtcgaccgccatctgcaacttgcttttggtgaccgggaacgtggcgcggccgggcacgggtgcgtatccgctgcgcggtcacaacaacgtgcagggagccggtgacatgggctgcgcgcctccgttcctgccgggctacgagcgcgtggacaacgaagagcagcggcgcaagtgggagaagctctggggcgtcgaactgccgaccacgcctgggctcaacaatcatcagatggtggatgccattcacgaaggcaagctgaaggcgatgtacctctgcggggaggacatggcggtggtggactccaacgccaactacgtggaggacgccttccggaaactcgagttcttcgtggtccaggacgtcttcctgtccaagaccgcgcagttcgcggacgtggtccttccggcctgcccgagccttgagaaggagggcacgttcacgaacaccgagcggcgcatccagcgcttgtatcgggtgcttgaaccgctgggagacgcgaagccggactgggagatcattcaaatggtcgccaaccggtttggcgcccattggaactacacatctgcgcgcgagattttcgaggagatggcgagtgcggccgatctgttccggggggcgtcgtacgaccgcctcgagggctacgggagcctgcagtggcccgtgcttcccgacggcaccgacacgccgctcctgtacacggacggcttcgcattccccgacaagaaggcgcggctctatccggtcgactggacgccgcccatcgaagtcggggaggaatacgatctagagttgaacaacgggcgcttgctcgagcacttccacgagggcaacatgacgagccgcgtgcccggtatccacgaaaaagtgccggaaaccttcgtcgagatctcgccggagctcgcgaaggagcgcggtgtccaggacggcgcgctggtgcgcctcgtctcgccgtacggcagcatcaaggtgcgcgtggccgtgacggatcgcgtgtccgggaaacacgtgtacgttccgctcttgtcccatgcggacgaggaggcggtcaaccgcctcacgtcgagcgatcacgacaccgccacctacacgcctgcctataaggaaatgcgcgtgcgcatggaggtcatccaatcgtgtggcgagccgcccatcaagcgcgggaacttccgcctgggcaagccgaacccgcagcccggtgtgaacgtcgagcaaaagtgggcgcgcaaggactacgtgccgctggtgacggatcgcgcgcttgtgaaggagggttga

SEQ ID NO: 864 - DNA, 2985 bp, Artificial
  Substituion in SEQ ID NO 852
atgatcgatatcaggaccgaagcacaggccgaggcgcggaccgtgcaactcgagatcgacggcaaggaagtcaccgtggaacgaggtgcgtcggtgctcgacgccattctgtccacgggccaggaacatccgcacgtctgttatcatccggcgctcggccccattgaaacgtgcgacacctgcattgtcgagatcgacggcaagctgatgcgcgcgtgttccacacctgtcgaggacgggatggcggtccggaccaagtccgtggccgcgcggtatgcccgcaaagaggcgatggaccgcattctgaagaaccacgagctgtactgcaccgtgtgcgacaacaacaacggcaactgcgtgctgcacaacaccgtgatgcagatgggcgtggaacatcaggcgtatccgttcacgcccaagccgtacgaggtcgacatgtcgaacccgttttatcggtacgatccgcagcagtgcatcctttgcggccgctgcgtcgaggcgtgccaaaacctgcaggtgagcgaggttctctccatcgcgtgggatcgcgaggtgccgcgggtcatctgggacaacgacgtgcccatcaacgagtcgtcgtgtgtgtcgtgtggccactgcgtgacggtctgtccgaccaacgcgctcatggaaaaatccatgcttggggaagcgggcttcctcacgggcatcgaaaagccgaccctggataagatgatcgacatcaccaagaaggtcgagcccggttactcgtccatctttgtcgtctcggagattgagcacgagatgcgcgaagcgcgcattcggaagacgaagacggtctgcacgtattgcggcgtgggctgcgcgttcgacgtgtggacgaaggatcggcacattttaaaggtcgagccgcagatggaggcgccggtcaaccagatctccacgtgcgtcaagggcaagttcggctgggactttgtgaacagcccggatcgcctgaccaagcctctggtgcgcaagggcgatcggttcgtggaagtgagctgggacgaggcgctcgacgtgatcgaacggcgcatcaaggagatccaggcgaagcacgggtacgacgcggtggcgttcatctcgtcgtccaagacgaccaacgaagaaaactacctgatgcagaagctggcgcgcgccgtcatgcacacgaacaacatcgacaactgctcgcgttactgccagtctcctgcgaccgaggcgctgcggcggaccatggggctcggcggcgacaccggatctatcaaggatctggagctggccgatctcgtcctcatcgtcggcgcgaaccctgccgaggcgcatcccgtgttgtcgacgcgcctgcgccgggcgcagaagaagcgcggccagaagcacatcgtggccgacgtgcggcgcaacatcatggcgacacgcgccgatctcttcatccagccgcgccagggcacggacttggtctggttgtccgcggtgacgaagtacatcatcgatcagggccggcacgacgaggcattcctgcgggatcgcgtgaatggctttgacgaatacgtgcagtcgctcgagaagttcacgctggactacgcgagcgagatctgcggcctccgcaaagaggagctcgtccgcgtggccgagatgatcatggaggcaaagcgcgtcgcggtctgctgggccatgggcgtgacgcagcaccggggtggcagtgacacgtcgaccgccatctgcaacttgcttttggtgaccgggaacgtggcgcggccgggcacgggtgcgtatccgctgcgcggtcacaacaacgtgcagggagccggtgacatgggctgcgcgcctccgttcctgccgggctacgagcgcgtggacaacgaagagcagcggcgcaagtgggagaagctctggggcgtcgaactgccgaccacgcctgggctcaacaatcatcagatggtggatgccattcacgaaggcaagctgaaggcgatgtacctctgcggggaggacatggcggtggtggactccaacgccaactacgtggaggacgccttccggaaactcgagttcttcgtggtccaggacgtcttcctgtccaagaccgcgcagttcgcggacgtggtccttccggcctgcccgagccttgagaaggagggcacgttcacgaacaccgagcggcgcatccagcgcttgtatcgggtgcttgaaccgctgggagacgcgaagccggactgggagatcattcaaatggtcgccaaccggtttggcgcccattggaactacacatctgcgcgcgagattttcgaggagatggcgagtgcggccgatctgttccggggggcgtcgtacgaccgcctcgagggctacgggagcctgcagtggcccgtgcttcccgacggcaccgacacgccgctcctgtacacggacggcttcgcattccccgacaagaaggcgcggctctatccggtcgactggacgccgcccatcgaagtcggggaggaatacgatctagagttgaacaacgggcgcttgctcgagcacttccacgagggcaacatgacgagccgcgtgcccggtatccacgaaaaagtgccggaaaccttcgtcgagatctcgccggagctcgcgaaggagcgcggtgtccaggacggcgcgctggtgcgcctcgtctcgccgtacggcagcatcaaggtgcgcgtggccgtgacggatcgcgtgtccgggaaacacgtgtacgttccgctcttgtcccatgcggacgaggaggcggtcaaccgcctcacgtcgagcgatcacgacaccgccacctacacgcctgcctataaggaaatgcgcgtgcgcatggaggtcatccaatcgtgtggcgagccgcccatcaagcgcgggaacttccgcctgggcaagccgaacccgcagcccggtgtgaacgtcgagcaaaagtgggcgcgcaaggactacgtgccgctggtgacggatcgcgcgcttgtgaaggatggttga

SEQ ID NO: 865 - DNA, 2985 bp, Artificial
  Substituion in SEQ ID NO 852
atgatcgatatcaggaccgaagcacaggccgaggcgcggaccgtgcaactcgagatcgacggcaaggaagtcaccgtggaacgaggtgcgtcggtgctcgacgccattctgtccacgggccaggaacatccgcacgtctgttatcatccggcgctcggccccattgaaacgtgcgacacctgcattgtcgagatcgacggcaagctgatgcgcgcgtgttccacacctgtcgaggacgggatggcggtccggaccaagtccgtggccgcgcggtatgcccgcaaagaggcgatggaccgcattctgaagaaccacgagctgtactgcaccgtgtgcgacaacaacaacggcaactgcgtgctgcacaacaccgtgatgcagatgggcgtggaacatcaggcgtatccgttcacgcccaagccgtacgaggtcgacatgtcgaacccgttttatcggtacgatccgcagcagtgcatcctttgcggccgctgcgtcgaggcgtgccaaaacctgcaggtgagcgaggttctctccatcgcgtgggatcgcgaggtgccgcgggtcatctgggacaacgacgtgcccatcaacgagtcgtcgtgtgtgtcgtgtggccactgcgtgacggtctgtccgaccaacgcgctcatggaaaaatccatgcttggggaagcgggcttcctcacgggcatcgaaaagccgaccctggataagatgatcgacatcaccaagaaggtcgagcccggttactcgtccatctttgtcgtctcggagattgagcacgagatgcgcgaagcgcgcattcggaagacgaagacggtctgcacgtattgcggcgtgggctgcgcgttcgacgtgtggacgaaggatcggcacattttaaaggtcgagccgcagatggaggcgccggtcaaccagatctccacgtgcgtcaagggcaagttcggctgggactttgtgaacagcccggatcgcctgaccaagcctctggtgcgcaagggcgatcggttcattgaagtgagctgggacgaggcgctcgacgtgatcgaacggcgcatcaaggagatccaggcgaagcacgggtacgacgcggtggcgttcatctcgtcgtccaagacgaccaacgaagaaaactacctgatgcagaagctggcgcgcgccgtcatgcacacgaacaacatcgacaactgctcgcgttactgccagtctcctgcgaccgaggcgctgcggcggaccatggggctcggcggcgacaccggatctatcaaggatctggagctggccgatctcgtcctcatcgtcggcgcgaaccctgccgaggcgcatcccgtgttgtcgacgcgcctgcgccgggcgcagaagaagcgcggccagaagcacatcgtggccgacgtgcggcgcaacatcatggcgacacgcgccgatctcttcatccagccgcgccagggcacggacttggtctggttgtccgcggtgacgaagtacatcatcgatcagggccggcacgacgaggcattcctgcgggatcgcgtgaatggctttgacgaatacgtgcagtcgctcgagaagttcacgctggactacgcgagcgagatctgcggcctccgcaaagaggagctcgtccgcgtggccgagatgatcatggaggcaaagcgcgtcgcggtctgctgggccatgggcgtgacgcagcaccggggtggcagtgacacgtcgaccgccatctgcaacttgcttttggtgaccgggaacgtggcgcggccgggcacgggtgcgtatccgctgcgcggtcacaacaacgtgcagggagccggtgacatgggctgcgcgcctccgttcctgccgggctacgagcgcgtggacaacgaagagcagcggcgcaagtgggagaagctctggggcgtcgaactgccgaccacgcctgggctcaacaatcatcagatggtggatgccattcacgaaggcaagctgaaggcgatgtacctctgcggggaggacatggcggtggtggactccaacgccaactacgtggaggacgccttccggaaactcgagttcttcgtggtccaggacgtcttcctgtccaagaccgcgcagttcgcggacgtggtccttccggcctgcccgagccttgagaaggagggcacgttcacgaacaccgagcggcgcatccagcgcttgtatcgggtgcttgaaccgctgggagacgcgaagccggactgggagatcattcaaatggtcgccaaccggtttggcgcccattggaactacacatctgcgcgcgagattttcgaggagatggcgagtgcggccgatctgttccggggggcgtcgtacgaccgcctcgagggctacgggagcctgcagtggcccgtgcttcccgacggcaccgacacgccgctcctgtacacggacggcttcgcattccccgacaagaaggcgcggctctatccggtcgactggacgccgcccatcgaagtcggggaggaatacgatctagagttgaacaacgggcgcttgctcgagcacttccacgagggcaacatgacgagccgcgtgcccggtatccacgaaaaagtgccggaaaccttcgtcgagatctcgccggagctcgcgaaggagcgcggtgtccaggacggcgcgctggtgcgcctcgtctcgccgtacggcagcatcaaggtgcgcgtggccgtgacggatcgcgtgtccgggaaacacgtgtacgttccgctcttgtcccatgcggacgaggaggcggtcaaccgcctcacgtcgagcgatcacgacaccgccacctacacgcctgcctataaggaaatgcgcgtgcgcatggaggtcatccaatcgtgtggcgagccgcccatcaagcgcgggaacttccgcctgggcaagccgaacccgcagcccggtgtgaacgtcgagcaaaagtgggcgcgcaaggactacgtgccgctggtgacggatcgcgcgcttgtgaaggagggttga

SEQ ID NO: 866 - DNA, 2985 bp, Artificial
  Substituion in SEQ ID NO 852
atgatcgatatcaggaccgaagcacaggccgaggcgcggaccgtgcaactcgagatcgacggcaaggatgtcaccgtggaacgaggtgcgtcggtgctcgacgccattctgtccacgggccaggaacatccgcacgtctgttatcatccggcgctcggccccattgaaacgtgcgacacctgcattgtcgagatcgacggcaagctgatgcgcgcgtgttccacacctgtcgaggacgggatggcggtccggaccaagtccgtggccgcgcggtatgcccgcaaagaggcgatggaccgcattctgaagaaccacgagctgtactgcaccgtgtgcgacaacaacaacggcaactgcgtgctgcacaacaccgtgatgcagatgggcgtggaacatcaggcgtatccgttcacgcccaagccgtacgaggtcgacatgtcgaacccgttttatcggtacgatccgcagcagtgcatcctttgcggccgctgcgtcgaggcgtgccaaaacctgcaggtgagcgaggttctctccatcgcgtgggatcgcgaggtgccgcgggtcatctgggacaacgacgtgcccatcaacgagtcgtcgtgtgtgtcgtgtggccactgcgtgacggtctgtccgaccaacgcgctcatggaaaaatccatgcttggggaagcgggcttcctcacgggcatcgaaaagccgaccctggataagatgatcgacatcaccaagaaggtcgagcccggttactcgtccatctttgtcgtctcggagattgagcacgagatgcgcgaagcgcgcattcggaagacgaagacggtctgcacgtattgcggcgtgggctgcgcgttcgacgtgtggacgaaggatcggcacattttaaaggtcgagccgcagatggaggcgccggtcaaccagatctccacgtgcgtcaagggcaagttcggctgggactttgtgaacagcccggatcgcctgaccaagcctctggtgcgcaagggcgatcggttcgtggaagtgagctgggacgaggcgctcgacgtgatcgaacggcgcatcaaggagatccaggcgaagcacgggtacgacgcggtggcgttcatctcgtcgtccaagacgaccaacgaagaaaactacctgatgcagaagctggcgcgcgccgtcatgcacacgaacaacatcgacaactgctcgcgttactgccagtctcctgcgaccgaggcgctgcggcggaccatggggctcggcggcgacaccggatctatcaaggatctggagctggccgatctcgtcctcatcgtcggcgcgaaccctgccgaggcgcatcccgtgttgtcgacgcgcctgcgccgggcgcagaagaagcgcggccagaagcacatcgtggccgacgtgcggcgcaacatcatggcgacacgcgccgatctcttcatccagccgcgccagggcacggacttggtctggttgtccgcggtgacgaagtacatcatcgatcagggccggcacgacgaggcattcctgcgggatcgcgtgaatggctttgacgaatacgtgcagtcgctcgagaagttcacgctggactacgcgagcgagatctgcggcctccgcaaagaggagctcgtccgcgtggccgagatgatcatggaggcaaagcgcgtcgcggtctgctgggccatgggcgtgacgcagcaccggggtggcagtgacacgtcgaccgccatctgcaacttgcttttggtgaccgggaacgtggcgcggccgggcacgggtgcgtatccgctgcgcggtcacaacaacgtgcagggagccggtgacatgggctgcgcgcctccgttcctgccgggctacgagcgcgtggacaacgaagagcagcggcgcaagtgggagaagctctggggcgtcgaactgccgaccacgcctgggctcaacaatcatcagatggtggatgccattcacgaaggcaagctgaaggcgatgtacctctgcggggaggacatggcggtggtggactccaacgccaactacgtggaggacgccttccggaaactcgagttcttcgtggtccaggacgtcttcctgtccaagaccgcgcagttcgcggacgtggtccttccggcctgcccgagccttgagaaggagggcacgttcacgaacaccgagcggcgcatccagcgcttgtatcgggtgcttgaaccgctgggagacgcgaagccggactgggagatcattcaaatggtcgccaaccggtttggcgcccattggaactacacatctgcgcgcgagattttcgaggagatggcgagtgcggccgatctgttccggggggcgtcgtacgaccgcctcgagggctacgggagcctgcagtggcccgtgcttcccgacggcaccgacacgccgctcctgtacacggacggcttcgcattccccgacaagaaggcgcggctctatccggtcgactggacgccgcccatcgaagtcggggaggaatacgatctagagttgaacaacgggcgcttgctcgagcacttccacgagggcaacatgacgagccgcgtgcccggtatccacgaaaaagtgccggaaaccttcgtcgagatctcgccggagctcgcgaaggagcgcggtgtccaggacggcgcgctggtgcgcctcgtctcgccgtacggcagcatcaaggtgcgcgtggccgtgacggatcgcgtgtccgggaaacacgtgtacgttccgctcttgtcccatgcggacgaggaggcggtcaaccgcctcacgtcgagcgatcacgacaccgccacctacacgcctgcctataaggaaatgcgcgtgcgcatggaggtcatccaatcgtgtggcgagccgcccatcaagcgcgggaacttccgcctgggcaagccgaacccgcagcccggtgtgaacgtcgagcaaaagtgggcgcgcaaggactacgtgccgctggtgacggatcgcgcgcttgtgaaggagggttga

SEQ ID NO: 867 - DNA, 2985 bp, Artificial
  Substituion in SEQ ID NO 852
atgatcgatatcaggaccgaagcacaggccgaggcgcggaccgtgcaactcgagatcgacggcaaggaagtcaccgtggaacgaggtgcgtcggtgctcgacgccattctgtccacgggccaggaacatccgcacgtctgttatcatccggcgctcggccccattgaaacgtgcgacacctgcattgtcgagatcgacggcaagctgatgcgcgcgtgttccacacctattgaggacgggatggcggtccggaccaagtccgtggccgcgcggtatgcccgcaaagaggcgatggaccgcattctgaagaaccacgagctgtactgcaccgtgtgcgacaacaacaacggcaactgcgtgctgcacaacaccgtgatgcagatgggcgtggaacatcaggcgtatccgttcacgcccaagccgtacgaggtcgacatgtcgaacccgttttatcggtacgatccgcagcagtgcatcctttgcggccgctgcgtcgaggcgtgccaaaacctgcaggtgagcgaggttctctccatcgcgtgggatcgcgaggtgccgcgggtcatctgggacaacgacgtgcccatcaacgagtcgtcgtgtgtgtcgtgtggccactgcgtgacggtctgtccgaccaacgcgctcatggaaaaatccatgcttggggaagcgggcttcctcacgggcatcgaaaagccgaccctggataagatgatcgacatcaccaagaaggtcgagcccggttactcgtccatctttgtcgtctcggagattgagcacgagatgcgcgaagcgcgcattcggaagacgaagacggtctgcacgtattgcggcgtgggctgcgcgttcgacgtgtggacgaaggatcggcacattttaaaggtcgagccgcagatggaggcgccggtcaaccagatctccacgtgcgtcaagggcaagttcggctgggactttgtgaacagcccggatcgcctgaccaagcctctggtgcgcaagggcgatcggttcgtggaagtgagctgggacgaggcgctcgacgtgatcgaacggcgcatcaaggagatccaggcgaagcacgggtacgacgcggtggcgttcatctcgtcgtccaagacgaccaacgaagaaaactacctgatgcagaagctggcgcgcgccgtcatgcacacgaacaacatcgacaactgctcgcgttactgccagtctcctgcgaccgaggcgctgcggcggaccatggggctcggcggcgacaccggatctatcaaggatctggagctggccgatctcgtcctcatcgtcggcgcgaaccctgccgaggcgcatcccgtgttgtcgacgcgcctgcgccgggcgcagaagaagcgcggccagaagcacatcgtggccgacgtgcggcgcaacatcatggcgacacgcgccgatctcttcatccagccgcgccagggcacggacttggtctggttgtccgcggtgacgaagtacatcatcgatcagggccggcacgacgaggcattcctgcgggatcgcgtgaatggctttgacgaatacgtgcagtcgctcgagaagttcacgctggactacgcgagcgagatctgcggcctccgcaaagaggagctcgtccgcgtggccgagatgatcatggaggcaaagcgcgtcgcggtctgctgggccatgggcgtgacgcagcaccggggtggcagtgacacgtcgaccgccatctgcaacttgcttttggtgaccgggaacgtggcgcggccgggcacgggtgcgtatccgctgcgcggtcacaacaacgtgcagggagccggtgacatgggctgcgcgcctccgttcctgccgggctacgagcgcgtggacaacgaagagcagcggcgcaagtgggagaagctctggggcgtcgaactgccgaccacgcctgggctcaacaatcatcagatggtggatgccattcacgaaggcaagctgaaggcgatgtacctctgcggggaggacatggcggtggtggactccaacgccaactacgtggaggacgccttccggaaactcgagttcttcgtggtccaggacgtcttcctgtccaagaccgcgcagttcgcggacgtggtccttccggcctgcccgagccttgagaaggagggcacgttcacgaacaccgagcggcgcatccagcgcttgtatcgggtgcttgaaccgctgggagacgcgaagccggactgggagatcattcaaatggtcgccaaccggtttggcgcccattggaactacacatctgcgcgcgagattttcgaggagatggcgagtgcggccgatctgttccggggggcgtcgtacgaccgcctcgagggctacgggagcctgcagtggcccgtgcttcccgacggcaccgacacgccgctcctgtacacggacggcttcgcattccccgacaagaaggcgcggctctatccggtcgactggacgccgcccatcgaagtcggggaggaatacgatctagagttgaacaacgggcgcttgctcgagcacttccacgagggcaacatgacgagccgcgtgcccggtatccacgaaaaagtgccggaaaccttcgtcgagatctcgccggagctcgcgaaggagcgcggtgtccaggacggcgcgctggtgcgcctcgtctcgccgtacggcagcatcaaggtgcgcgtggccgtgacggatcgcgtgtccgggaaacacgtgtacgttccgctcttgtcccatgcggacgaggaggcggtcaaccgcctcacgtcgagcgatcacgacaccgccacctacacgcctgcctataaggaaatgcgcgtgcgcatggaggtcatccaatcgtgtggcgagccgcccatcaagcgcgggaacttccgcctgggcaagccgaacccgcagcccggtgtgaacgtcgagcaaaagtgggcgcgcaaggactacgtgccgctggtgacggatcgcgcgcttgtgaaggagggttga

SEQ ID NO: 868 - protein, 529 aa, Alicyclobacillus acidocaldarius
MSYVYLLDTTLRDGTQGEGVSLTVADKLKIAEKLDDLGVAYIEGGFPGANPKDEEFFRAAKSLHLKHAKLTAFGSTRRPGVRVEDDASVRAVLDASTPVVAIVGKAWDFHVTEALRIDLDENLAMIRDTVQYLKQHGREVIFDAEHFFDGFKRNRAYALATVRAAWEAGVDWVALCDTNGGSMPHEIHEMVTQVIQEVPVQVGIHTHNDCELAVANSLAAVQAGARMVHGTINGIGERCGNANLASIIPNLELKLGYPCLPSRDHLRLLTPVARFVGEVCNLVAHSYQPFVGHSAFAHKGGIHVSAIQRDPETYEHIPPELVGNERRVLLSELSGVSNVLAQAQAFGIPTEGRETELRRLLERIKQMEHMGYQFEGAEASQELLFRRVLNDFTPPFKVLAVRVDTDVQRQGEATSQAIIKLEVDGEIVHTVSEGNGPVNALDAVLRKALAPHRPEIRRMHLTDYKVRVLDEKDATAARVRVLIESTDGEHVWRTVGVSENVIAASWEALVDSIQYYLALVVPSQALVEA

SEQ ID NO: 869 - DNA, 1590 bp, Alicyclobacillus acidocaldarius
atgagctacgtgtatttgctcgataccacattgcgggatggcacgcagggcgagggggtcagcctcaccgtcgccgacaaactcaagattgcagaaaagttggacgatctcggcgtcgcctacatcgaaggcggctttccgggcgcgaatccgaaggatgaggagtttttccgcgccgcgaagtcgcttcacctcaagcacgcgaagctcacggcgtttggctccacgcgccgccccggggttcgcgtcgaggacgacgcgagcgtgcgggccgtgctggacgcttcgacgcctgtggtcgcgatcgtcgggaaagcctgggattttcatgtgacggaggccctccggatcgatctcgacgagaacctcgcgatgatcagggacaccgtgcagtacttgaagcagcacgggcgcgaggtcatcttcgacgcggagcactttttcgacggattcaagcgaaaccgagcgtatgcgctcgcgacggttcgggcggcgtgggaggccggcgtggactgggtggcgctttgcgatacgaacggcgggagcatgccgcacgagatccacgagatggtcacacaggtcattcaggaagtgccggtccaagtcggcattcacacgcataacgactgcgaactggcggtggccaacagcctcgccgcggttcaggcgggtgcccggatggtgcacgggaccatcaatggcatcggggagcgctgcggaaatgccaatttggcctccatcattccgaaccttgagctgaaactcgggtatccgtgcctgccttctcgcgaccatctgcggctgctgacgccggtggcccggtttgtcggggaagtctgcaatctcgtggcgcacagttaccagccattcgtcggccacagcgcgtttgcccataagggcggcatccacgtgagcgccatccagcgagatcccgagacatatgagcacattcctccggaactcgtcggcaacgagcgccgcgtcctgctctcggagttgtcgggcgtttcgaacgtcttggcgcaggcgcaggcgttcggtatcccgacggaggggcgagagaccgagcttaggcgcttgctcgagcgcatcaagcagatggagcacatggggtatcagttcgagggcgccgaggcgtcgcaggaacttttgttccgtcgcgtcctcaacgatttcacgccgccttttaaggtccttgctgtgcgcgtggataccgacgtgcagcgccaaggcgaggcgacgtctcaggccatcatcaagctcgaggtggacggagaaatcgtccacaccgtgtccgagggcaacgggccggtcaatgcgctcgacgcggtgttgcgcaaggcgctcgctccgcatcgccccgaaatccgccgcatgcacctcacggactacaaggtccgcgtgttggacgaaaaggatgcgacggcggccagggtccgcgtcttgatagaatcgacggacggcgaacacgtctggcggacagtcggcgtatcggaaaacgtgattgccgcgagctgggaggcgctcgtcgatagcatccagtactacctggcgctcgtggtgccgagccaggcgctcgtcgaagcttga

SEQ ID NO: 870 - protein, 511 aa, Moorella thermoacetica ATCC 39073
ILIYDTTLRDGSQGEGISLSVEDKLKIASRLDRLGVDYIEGGWPWANPKDMEFFLRAREVIWRQARLVAFGRTRKPGQAAAEDANLLAIKRAGVKVATIFGKSWDLHVTAALGTTLAENLAMIGDSVAFLVDQGLEVIYDAEHFFDGFKANPDYALETLKAAAKAGASWIVLCDTNGGCLPWEIEEAVARVRQEIQVPVGIHAHNDGDLAVANTLAAVTAGCRQVQGTINGFGERCGNADLCSVMPNLELKMGYQCLPPGQLAFLTEVSRYVSEIANVVPAGNQPFVGYSAFAHKGGIHVSAVLKAPDTYEHIRPQQVGNERRVLMSDQAGASNLRCKAEEMGLELNPERERGIIEGIKELERQGYQFEGADASLELFLRKTTGEYRQQFEVEYVKALVEKRAGQEAISEAIVKLRVGDQVVHTAAEGNGPVNAMDNALRKALEEVFPAIRHMRLTDYKVRVLDEKDATSARVRVLIESRDGSNSWNTVGVSTNIIEASWEALLDSMEYAL

SEQ ID NO: 871 - protein, 516 aa, Pelotomaculum thermopropionicum SI
MPSVKIYDTTLRDGAQAEGISFSVEDKIKIALRLDKMGFHYIEGGWPGSNPKDLEFFKKIRHCPLRHARLAAFGSTRKAGAAAENDASVKAIIDSGVQVATIFGKSWDFHVFKALGVTLEENLAMIRETVAYLKSRGLEVIYDAEHFFDGCKANPAYALETIRAAAESGASAVVLCDTNGGTLPAEVKELVEKARSVLGVPVGIHAHNDGELAVANTLAAVQAGAEQVQGTVNGYGERCGNANLCSVIPNLTLKCGIETIPREKLVHLTDLSHFVSEVANISPNPHQPFVGASAFAHKGGVHVSALLKDSRTYEHISPGEVGNRRRVLVSELSGMSNLLYKYKELNLDIERQSPEGKRILEDIKKLESQGFQFEDAEGSFELLVRKTNHGYRDPFILEALRLLVEIKENTPAYSEAIIKMRVGDRVVHTAAEGNGPVNALDNALRKALYDFYPCIGSMHLTDYKVRVLEEKDGTGAAVRVHIQTGDGKRSWGTVGVSRNIIEASWQALADSISYGL

SEQ ID NO: 872 - protein, 510 aa, Desulfotomaculum reducens MI-1
MYDTTLRDGTQGEGVSLSAEDKVKIALRLDEMGFQYIEGGWPGSNPKDMEFFQKIQQYSLRNAQVTAFGSTCRPGVEPHEDANINCLLEAGAKIATIFGKCWDFHVTKALNTTLEENLRMVRESVAYLKSKGLMVFFDGEHFFDGYKANADYALSVLKAAVQGGAATVILCDTNGGSMPQEIQRAVTHVVEELPGVELGIHAHNDGEMAVANSIMAVQAGVSQVQGTVNGLGERCGNANLCSIIPNLALKMGYSTIPAENLVYLTELSRYVYELANLNPIANQPFVGESAFAHKGGIHVSALMKEPGTYEHMNPEAVGNVRRVLMSELAGISNLLYKYKELHLDKSSPEGRQVLEKLKNMEHGGYQFEAAEGSLELMLRKAMNGYREPFQLESMRLILEMREENPIHSEAVIKLKVGDQVVHTAAEGNGPVHALDNALRKALETFYPEVAGMRLSDYKVRVLEEKAGTEARVRVLIETGDGKKTWGTVGVSTNIIEASWQALADSMAYGL

SEQ ID NO: 873 - protein, 520 aa, Herpetosiphon aurantiacus ATCC 23779
IFLYDTTLRDGTQREGLSLSLADKLKIARELDRFGMHYIEGGWPGSNPKDAAFFAEAAKMEWKHAKIAAFGSTRRANSKPETDANLKALLDANTPVVTLVGKSWTLHVTEVLETTLEENLAMIRDSVALMKAHGKEVIYDAEHFFDGYRADNDYALATIKAAAEAGADWIVLCDTNGGSLPDWISAVVQRVKGKINTQLGIHTHNDSELAVANSLAAIVGGCRQVQGTINGYGERCGNANLISIIPNLQLKMGMFCVLPDQLQRLTELSRTVSEIANLNPDEHAAYVGNSAFAHKGGIHVAAVAKVEHSYQHIEPVQVGNRKRVVISELSGRGNIKMRAEELGVESTGLERGVLERVKLLESKGFQFEAAEGSFELLVRRAAADYAAPFKLLDVVTIVEQRRGVEMQAEATVKLQIGEEIYHTAASGNGPVNALDQAMRKALLSRYPELAEVHLVDYKVRILDSESATGATTRVLIEAAMGDERWTTVGCSENIIEASWQALVDSLELPLVRARSNQPVL

SEQ ID NO: 874 - protein, 515 aa, Aquifex aeolicus VF5
VYIYDTTLRDGSQMEGVSFSLEDKIRIAEKLDDFGIHYIEGGWPYANPKDNLFFQKAKKMNFKNAKLTAFGSTRRPNKKVSEDPQVESLIKAETPVVTIFGKSWDLHVTDALKTTLEENLNMIYETVEYLKRYVDEVIFDAEHFFDGYKSNPEYALQVLEAALKGGADWVVLCDTNGGTLPHEIYEITKKVKERFKDANVGIHAHNDSETAVANSLMAVLAGARQVHGTINGIGERTGNANLCSIIPNLQLKLGFDVIPQENLKKLTELANFVAEIINMPLPRNMPYVGESAFAHKGGVHASAVLKNAKTYEHINPELVGNKRKITVSDLAGRSNLVHKLKEFGIEIDPKSPELKKLIDKIKELEKEGYHFEAAEASLELLIKRHFGLVKDYFDFDAYRVLIAKRRDDSLPTSEATVRLSVEGVEEHTASLGNGPISALDRALRKALEEFYPNLKELQLIDYKVRIINESAGTSAKVRVLIESTDGKRKWGTVGVSENVIEASWIALRDSIVYKL

SEQ ID NO: 875 - protein, 529 aa, Artificial
  Substituion in SEQ ID NO 868
MSYVYLLDTTLRDGTQGEGVSLTVADKLKIAEKLDDLGVAYIEGGFPGANPKDEEFFRAAKSLHLKHAKLTAFGSTRRPGVRVEDDASVRAVLDASTPVVAIVGKAWDFHVTEALRIDLDENLAMIRDTVQYLKQHGREVIFDAEHFFDGFKRNRAYALATVRAAWEAGVDWVALCDTNGGSMPHEIHEMVTQVIQEVPVQVGIHTHNDCELAVANSLAAVQAGARMVHGTINGIGERCGNANLASIIPNLELKLGYPCLPSRDHLRLLTPVARFVGEVCNLVAHSYQPFVGHSAFAHKGGIHVSAIQRDPETYEHIPPELVGNERRVLLSELSGVSNVLAQAQAFGIPTEGRETELRRLLERIKQMEHMGYQFEGAEASQELLFRRVLNDFTPPFKVLAVRVDTDVQRQGEATSQALIKLEVDGEIVHTVSEGNGPVNALDAVLRKALAPHRPEIRRMHLTDYKVRVLDEKDATAARVRVLIESTDGEHVWRTVGVSENVIAASWEALVDSIQYYLALVVPSQALVEA

SEQ ID NO: 876 - protein, 529 aa, Artificial
  Substituion in SEQ ID NO 868
MSYVYLLDTTLRDGTQGEGVSLTVADKLKIAEKLDDLGVAYIEGGFPGANPKDEEFFRAARSLHLKHAKLTAFGSTRRPGVRVEDDASVRAVLDASTPVVAIVGKAWDFHVTEALRIDLDENLAMIRDTVQYLKQHGREVIFDAEHFFDGFKRNRAYALATVRAAWEAGVDWVALCDTNGGSMPHEIHEMVTQVIQEVPVQVGIHTHNDCELAVANSLAAVQAGARMVHGTINGIGERCGNANLASIIPNLELKLGYPCLPSRDHLRLLTPVARFVGEVCNLVAHSYQPFVGHSAFAHKGGIHVSAIQRDPETYEHIPPELVGNERRVLLSELSGVSNVLAQAQAFGIPTEGRETELRRLLERIKQMEHMGYQFEGAEASQELLFRRVLNDFTPPFKVLAVRVDTDVQRQGEATSQAIIKLEVDGEIVHTVSEGNGPVNALDAVLRKALAPHRPEIRRMHLTDYKVRVLDEKDATAARVRVLIESTDGEHVWRTVGVSENVIAASWEALVDSIQYYLALVVPSQALVEA

SEQ ID NO: 877 - protein, 529 aa, Artificial
  Substituion in SEQ ID NO 868
MSYVYLLDTTLRDGTQGEGVSLTVADKLKIAEKLDDLGVAYIEGGFPGANPKDEEFFRAAKSLHLKHAKLTAFGSTRRPGVRVEDDASVRAVLDASTPVVAIVGKAWDFHVTEALRIDLDENLAMIRDTVQYLKQHGREVIFDAEHFFDGFKRNRAYALATVRAAWEAGVDWVALCDTNGGSMPHEIHEMVTQVIQEVPVQVGIHTHNDCELAVANSLAAVQAGARMVHGTINGIGERCGNANLASIIPNLELKLGYPCLPSRDHLRLLTPVARFVGEVCNLVAHSYQPFVGHSAFAHKGGIHVSAIQRDPETYEHIPPELVGNERRVLLSELSGVSNVLAQAQAFGIPTEGRETELRRLLERIKQMEHMGYQFEGAEASQELLFRRVLNDFTPPFKVLAVRVDTDVQRQGEATSQAIIKLEVDGEIVHTVSDGNGPVNALDAVLRKALAPHRPEIRRMHLTDYKVRVLDEKDATAARVRVLIESTDGEHVWRTVGVSENVIAASWEALVDSIQYYLALVVPSQALVEA

SEQ ID NO: 878 - protein, 529 aa, Artificial
  Substituion in SEQ ID NO 868
MSYVYLLDTTLRDGTQGEGVSLTVADKLKIAEKLDDLGVAYIEGGFPGANPKDEEFFRAAKSLHLKHAKLTAFGSTRRPGVRVEDDASVRAVLDASTPVVAIVGKAWDFHVTEALRLDLDENLAMIRDTVQYLKQHGREVIFDAEHFFDGFKRNRAYALATVRAAWEAGVDWVALCDTNGGSMPHEIHEMVTQVIQEVPVQVGIHTHNDCELAVANSLAAVQAGARMVHGTINGIGERCGNANLASIIPNLELKLGYPCLPSRDHLRLLTPVARFVGEVCNLVAHSYQPFVGHSAFAHKGGIHVSAIQRDPETYEHIPPELVGNERRVLLSELSGVSNVLAQAQAFGIPTEGRETELRRLLERIKQMEHMGYQFEGAEASQELLFRRVLNDFTPPFKVLAVRVDTDVQRQGEATSQAIIKLEVDGEIVHTVSEGNGPVNALDAVLRKALAPHRPEIRRMHLTDYKVRVLDEKDATAARVRVLIESTDGEHVWRTVGVSENVIAASWEALVDSIQYYLALVVPSQALVEA

SEQ ID NO: 879 - protein, 529 aa, Artificial
  Substituion in SEQ ID NO 868
MSYVYLLDTTLRDGTQGEGVSLTVADKLKIAEKLDDLGVAYIEGGFPGANPKDEEFFRAAKSLHLKHAKLTAFGSTRRPGVRVEDDASVKAVLDASTPVVAIVGKAWDFHVTEALRIDLDENLAMIRDTVQYLKQHGREVIFDAEHFFDGFKRNRAYALATVRAAWEAGVDWVALCDTNGGSMPHEIHEMVTQVIQEVPVQVGIHTHNDCELAVANSLAAVQAGARMVHGTINGIGERCGNANLASIIPNLELKLGYPCLPSRDHLRLLTPVARFVGEVCNLVAHSYQPFVGHSAFAHKGGIHVSAIQRDPETYEHIPPELVGNERRVLLSELSGVSNVLAQAQAFGIPTEGRETELRRLLERIKQMEHMGYQFEGAEASQELLFRRVLNDFTPPFKVLAVRVDTDVQRQGEATSQAIIKLEVDGEIVHTVSEGNGPVNALDAVLRKALAPHRPEIRRMHLTDYKVRVLDEKDATAARVRVLIESTDGEHVWRTVGVSENVIAASWEALVDSIQYYLALVVPSQALVEA

SEQ ID NO: 880 - DNA, 1590 bp, Artificial
  Substituion in SEQ ID NO 869
atgagctacgtgtatttgctcgataccacattgcgggatggcacgcagggcgagggggtcagcctcaccgtcgccgacaaactcaagattgcagaaaagttggacgatctcggcgtcgcctacatcgaaggcggctttccgggcgcgaatccgaaggatgaggagtttttccgcgccgcgaagtcgcttcacctcaagcacgcgaagctcacggcgtttggctccacgcgccgccccggggttcgcgtcgaggacgacgcgagcgtgcgggccgtgctggacgcttcgacgcctgtggtcgcgatcgtcgggaaagcctgggattttcatgtgacggaggccctccggatcgatctcgacgagaacctcgcgatgatcagggacaccgtgcagtacttgaagcagcacgggcgcgaggtcatcttcgacgcggagcactttttcgacggattcaagcgaaaccgagcgtatgcgctcgcgacggttcgggcggcgtgggaggccggcgtggactgggtggcgctttgcgatacgaacggcgggagcatgccgcacgagatccacgagatggtcacacaggtcattcaggaagtgccggtccaagtcggcattcacacgcataacgactgcgaactggcggtggccaacagcctcgccgcggttcaggcgggtgcccggatggtgcacgggaccatcaatggcatcggggagcgctgcggaaatgccaatttggcctccatcattccgaaccttgagctgaaactcgggtatccgtgcctgccttctcgcgaccatctgcggctgctgacgccggtggcccggtttgtcggggaagtctgcaatctcgtggcgcacagttaccagccattcgtcggccacagcgcgtttgcccataagggcggcatccacgtgagcgccatccagcgagatcccgagacatatgagcacattcctccggaactcgtcggcaacgagcgccgcgtcctgctctcggagttgtcgggcgtttcgaacgtcttggcgcaggcgcaggcgttcggtatcccgacggaggggcgagagaccgagcttaggcgcttgctcgagcgcatcaagcagatggagcacatggggtatcagttcgagggcgccgaggcgtcgcaggaacttttgttccgtcgcgtcctcaacgatttcacgccgccttttaaggtccttgctgtgcgcgtggataccgacgtgcagcgccaaggcgaggcgacgtctcaggccttaatcaagctcgaggtggacggagaaatcgtccacaccgtgtccgagggcaacgggccggtcaatgcgctcgacgcggtgttgcgcaaggcgctcgctccgcatcgccccgaaatccgccgcatgcacctcacggactacaaggtccgcgtgttggacgaaaaggatgcgacggcggccagggtccgcgtcttgatagaatcgacggacggcgaacacgtctggcggacagtcggcgtatcggaaaacgtgattgccgcgagctgggaggcgctcgtcgatagcatccagtactacctggcgctcgtggtgccgagccaggcgctcgtcgaagcttga

SEQ ID NO: 881 - DNA, 1590 bp, Artificial
  Substituion in SEQ ID NO 869
atgagctacgtgtatttgctcgataccacattgcgggatggcacgcagggcgagggggtcagcctcaccgtcgccgacaaactcaagattgcagaaaagttggacgatctcggcgtcgcctacatcgaaggcggctttccgggcgcgaatccgaaggatgaggagtttttccgcgccgcgcgttcgcttcacctcaagcacgcgaagctcacggcgtttggctccacgcgccgccccggggttcgcgtcgaggacgacgcgagcgtgcgggccgtgctggacgcttcgacgcctgtggtcgcgatcgtcgggaaagcctgggattttcatgtgacggaggccctccggatcgatctcgacgagaacctcgcgatgatcagggacaccgtgcagtacttgaagcagcacgggcgcgaggtcatcttcgacgcggagcactttttcgacggattcaagcgaaaccgagcgtatgcgctcgcgacggttcgggcggcgtgggaggccggcgtggactgggtggcgctttgcgatacgaacggcgggagcatgccgcacgagatccacgagatggtcacacaggtcattcaggaagtgccggtccaagtcggcattcacacgcataacgactgcgaactggcggtggccaacagcctcgccgcggttcaggcgggtgcccggatggtgcacgggaccatcaatggcatcggggagcgctgcggaaatgccaatttggcctccatcattccgaaccttgagctgaaactcgggtatccgtgcctgccttctcgcgaccatctgcggctgctgacgccggtggcccggtttgtcggggaagtctgcaatctcgtggcgcacagttaccagccattcgtcggccacagcgcgtttgcccataagggcggcatccacgtgagcgccatccagcgagatcccgagacatatgagcacattcctccggaactcgtcggcaacgagcgccgcgtcctgctctcggagttgtcgggcgtttcgaacgtcttggcgcaggcgcaggcgttcggtatcccgacggaggggcgagagaccgagcttaggcgcttgctcgagcgcatcaagcagatggagcacatggggtatcagttcgagggcgccgaggcgtcgcaggaacttttgttccgtcgcgtcctcaacgatttcacgccgccttttaaggtccttgctgtgcgcgtggataccgacgtgcagcgccaaggcgaggcgacgtctcaggccatcatcaagctcgaggtggacggagaaatcgtccacaccgtgtccgagggcaacgggccggtcaatgcgctcgacgcggtgttgcgcaaggcgctcgctccgcatcgccccgaaatccgccgcatgcacctcacggactacaaggtccgcgtgttggacgaaaaggatgcgacggcggccagggtccgcgtcttgatagaatcgacggacggcgaacacgtctggcggacagtcggcgtatcggaaaacgtgattgccgcgagctgggaggcgctcgtcgatagcatccagtactacctggcgctcgtggtgccgagccaggcgctcgtcgaagcttga

SEQ ID NO: 882 - DNA, 1590 bp, Artificial
  Substituion in SEQ ID NO 869
atgagctacgtgtatttgctcgataccacattgcgggatggcacgcagggcgagggggtcagcctcaccgtcgccgacaaactcaagattgcagaaaagttggacgatctcggcgtcgcctacatcgaaggcggctttccgggcgcgaatccgaaggatgaggagtttttccgcgccgcgaagtcgcttcacctcaagcacgcgaagctcacggcgtttggctccacgcgccgccccggggttcgcgtcgaggacgacgcgagcgtgcgggccgtgctggacgcttcgacgcctgtggtcgcgatcgtcgggaaagcctgggattttcatgtgacggaggccctccggatcgatctcgacgagaacctcgcgatgatcagggacaccgtgcagtacttgaagcagcacgggcgcgaggtcatcttcgacgcggagcactttttcgacggattcaagcgaaaccgagcgtatgcgctcgcgacggttcgggcggcgtgggaggccggcgtggactgggtggcgctttgcgatacgaacggcgggagcatgccgcacgagatccacgagatggtcacacaggtcattcaggaagtgccggtccaagtcggcattcacacgcataacgactgcgaactggcggtggccaacagcctcgccgcggttcaggcgggtgcccggatggtgcacgggaccatcaatggcatcggggagcgctgcggaaatgccaatttggcctccatcattccgaaccttgagctgaaactcgggtatccgtgcctgccttctcgcgaccatctgcggctgctgacgccggtggcccggtttgtcggggaagtctgcaatctcgtggcgcacagttaccagccattcgtcggccacagcgcgtttgcccataagggcggcatccacgtgagcgccatccagcgagatcccgagacatatgagcacattcctccggaactcgtcggcaacgagcgccgcgtcctgctctcggagttgtcgggcgtttcgaacgtcttggcgcaggcgcaggcgttcggtatcccgacggaggggcgagagaccgagcttaggcgcttgctcgagcgcatcaagcagatggagcacatggggtatcagttcgagggcgccgaggcgtcgcaggaacttttgttccgtcgcgtcctcaacgatttcacgccgccttttaaggtccttgctgtgcgcgtggataccgacgtgcagcgccaaggcgaggcgacgtctcaggccatcatcaagctcgaggtggacggagaaatcgtccacaccgtgtccgatggcaacgggccggtcaatgcgctcgacgcggtgttgcgcaaggcgctcgctccgcatcgccccgaaatccgccgcatgcacctcacggactacaaggtccgcgtgttggacgaaaaggatgcgacggcggccagggtccgcgtcttgatagaatcgacggacggcgaacacgtctggcggacagtcggcgtatcggaaaacgtgattgccgcgagctgggaggcgctcgtcgatagcatccagtactacctggcgctcgtggtgccgagccaggcgctcgtcgaagcttga

SEQ ID NO: 883 - DNA, 1590 bp, Artificial
  Substituion in SEQ ID NO 869
atgagctacgtgtatttgctcgataccacattgcgggatggcacgcagggcgagggggtcagcctcaccgtcgccgacaaactcaagattgcagaaaagttggacgatctcggcgtcgcctacatcgaaggcggctttccgggcgcgaatccgaaggatgaggagtttttccgcgccgcgaagtcgcttcacctcaagcacgcgaagctcacggcgtttggctccacgcgccgccccggggttcgcgtcgaggacgacgcgagcgtgcgggccgtgctggacgcttcgacgcctgtggtcgcgatcgtcgggaaagcctgggattttcatgtgacggaggccctccggttagatctcgacgagaacctcgcgatgatcagggacaccgtgcagtacttgaagcagcacgggcgcgaggtcatcttcgacgcggagcactttttcgacggattcaagcgaaaccgagcgtatgcgctcgcgacggttcgggcggcgtgggaggccggcgtggactgggtggcgctttgcgatacgaacggcgggagcatgccgcacgagatccacgagatggtcacacaggtcattcaggaagtgccggtccaagtcggcattcacacgcataacgactgcgaactggcggtggccaacagcctcgccgcggttcaggcgggtgcccggatggtgcacgggaccatcaatggcatcggggagcgctgcggaaatgccaatttggcctccatcattccgaaccttgagctgaaactcgggtatccgtgcctgccttctcgcgaccatctgcggctgctgacgccggtggcccggtttgtcggggaagtctgcaatctcgtggcgcacagttaccagccattcgtcggccacagcgcgtttgcccataagggcggcatccacgtgagcgccatccagcgagatcccgagacatatgagcacattcctccggaactcgtcggcaacgagcgccgcgtcctgctctcggagttgtcgggcgtttcgaacgtcttggcgcaggcgcaggcgttcggtatcccgacggaggggcgagagaccgagcttaggcgcttgctcgagcgcatcaagcagatggagcacatggggtatcagttcgagggcgccgaggcgtcgcaggaacttttgttccgtcgcgtcctcaacgatttcacgccgccttttaaggtccttgctgtgcgcgtggataccgacgtgcagcgccaaggcgaggcgacgtctcaggccatcatcaagctcgaggtggacggagaaatcgtccacaccgtgtccgagggcaacgggccggtcaatgcgctcgacgcggtgttgcgcaaggcgctcgctccgcatcgccccgaaatccgccgcatgcacctcacggactacaaggtccgcgtgttggacgaaaaggatgcgacggcggccagggtccgcgtcttgatagaatcgacggacggcgaacacgtctggcggacagtcggcgtatcggaaaacgtgattgccgcgagctgggaggcgctcgtcgatagcatccagtactacctggcgctcgtggtgccgagccaggcgctcgtcgaagcttga

SEQ ID NO: 884 - DNA, 1590 bp, Artificial
  Substituion in SEQ ID NO 869
atgagctacgtgtatttgctcgataccacattgcgggatggcacgcagggcgagggggtcagcctcaccgtcgccgacaaactcaagattgcagaaaagttggacgatctcggcgtcgcctacatcgaaggcggctttccgggcgcgaatccgaaggatgaggagtttttccgcgccgcgaagtcgcttcacctcaagcacgcgaagctcacggcgtttggctccacgcgccgccccggggttcgcgtcgaggacgacgcgagcgtgaaagccgtgctggacgcttcgacgcctgtggtcgcgatcgtcgggaaagcctgggattttcatgtgacggaggccctccggatcgatctcgacgagaacctcgcgatgatcagggacaccgtgcagtacttgaagcagcacgggcgcgaggtcatcttcgacgcggagcactttttcgacggattcaagcgaaaccgagcgtatgcgctcgcgacggttcgggcggcgtgggaggccggcgtggactgggtggcgctttgcgatacgaacggcgggagcatgccgcacgagatccacgagatggtcacacaggtcattcaggaagtgccggtccaagtcggcattcacacgcataacgactgcgaactggcggtggccaacagcctcgccgcggttcaggcgggtgcccggatggtgcacgggaccatcaatggcatcggggagcgctgcggaaatgccaatttggcctccatcattccgaaccttgagctgaaactcgggtatccgtgcctgccttctcgcgaccatctgcggctgctgacgccggtggcccggtttgtcggggaagtctgcaatctcgtggcgcacagttaccagccattcgtcggccacagcgcgtttgcccataagggcggcatccacgtgagcgccatccagcgagatcccgagacatatgagcacattcctccggaactcgtcggcaacgagcgccgcgtcctgctctcggagttgtcgggcgtttcgaacgtcttggcgcaggcgcaggcgttcggtatcccgacggaggggcgagagaccgagcttaggcgcttgctcgagcgcatcaagcagatggagcacatggggtatcagttcgagggcgccgaggcgtcgcaggaacttttgttccgtcgcgtcctcaacgatttcacgccgccttttaaggtccttgctgtgcgcgtggataccgacgtgcagcgccaaggcgaggcgacgtctcaggccatcatcaagctcgaggtggacggagaaatcgtccacaccgtgtccgagggcaacgggccggtcaatgcgctcgacgcggtgttgcgcaaggcgctcgctccgcatcgccccgaaatccgccgcatgcacctcacggactacaaggtccgcgtgttggacgaaaaggatgcgacggcggccagggtccgcgtcttgatagaatcgacggacggcgaacacgtctggcggacagtcggcgtatcggaaaacgtgattgccgcgagctgggaggcgctcgtcgatagcatccagtactacctggcgctcgtggtgccgagccaggcgctcgtcgaagcttga

SEQ ID NO: 885 - protein, 358 aa, Alicyclobacillus acidocaldarius
MDDVQVYRFTGDTKPDQVLNEAGEMVGELPENAADLALEWYPFMIFCRKFDERAQLLQRQGRLGTYAPFRGQEAAQIASFAVLRPSDWVFPTYRELAGMMYHGLEPVHALLKSRGHPDAGRMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACEEEAEARVRQAVADMEAYPHKSLEEAARHVYAEVPEALALHLAKRGKEAR

SEQ ID NO: 886 - DNA, 1077 bp, Alicyclobacillus acidocaldarius
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggccgcatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggaggccgcgcgccacgtgtacgccgaggtcccggaggcactcgcgcttcatctcgccaaacgcggaaaggaggcgcgctga

SEQ ID NO: 887 - protein, 331 aa, Geobacillus thermodenitrificans NG80-2
QILDENGNGDEAKIAAFSDEWLLDAYRAMRRARVVDERLLRMQRQGRIGTYAPFSGQEAAQIGSVLALQKDDWIFPSYREVAVCLTHGMPLEQFFHYVRGRLSGKRMPEELNIFPTQIIIAAQTLHAVGCAWATKLKGESHVSVAYFGDGATSEGDFHEAMNFAAVYNVPVIFFCQNNQYAISVPYAKQTASRTIAQKALAYGMKGVLVDGNDVLAVYETMKQAVEAARRGEGPMLIEALTYRLGPHTTADDPTKYRHPEEVETWRRKDPLHRLRVLLERRGLWTDAKEEEFVAKVNEEVTAAYEAAVASESGSIADVFDYVYSEAPKLLA

SEQ ID NO: 888 - protein, 342 aa, Geobacillus kaustophilus HTA426
FDPDKLPVEIVRILDENGNGDEEKLAAFSDEWLLRAYREMRRARVIDERLLRMQRQGRIGTYAPFSGQEAAQIGSALALHKDDWIFPSYREVAVCLMHGMPLEQFFHYVQGRLSGKRMPEGVNIFPTQIIIAAQTLHAVGCAWASKLKGEPHVSVAYFGDGATSEGDFHEAMNFAAVYNVPVIFFCQNNQYAISVPYRKQTASRTIAQKALAYGMKGVLVDGNDVLAVYETMKQAVEAARRGEGPMLIEALTYRLGPHTTADDPTKYRRPEEVETWRAKDPLRRLRLLLERRGLWTEAQEDALVAQVNDEVTAAYEAAIASKSGSIVDAFDCVYSEAPKLLA

SEQ ID NO: 889 - protein, 329 aa, Exiguobacterium sibiricum 255-15
RILDDAGQVTDTSKTDLLTKDLSLALFTHMNRIRTFDRKAINLQRQGRLGTYAPFEGQEAAQVGSAYALQDKDWVFPTYRDHGATLTFGADMVRTFLYWNGRVEGCVATDELHIFPPAVPIATQIPHAVGAAWAEKRKGSTQVAVAYFGDGATSEGDFHEGMNFASVFQAPVILFNQNNGYAISVPIQKQMHSETIAQKALAYGMPSVRIDGNDVFAVYFTMQKALERARSGGGPTLIEAVTWRFGAHTTADDPSKYRDQERSRDRVDPLERLEAFMKEQGFYDEQEIETIRSRHQEEVEAAVKTMESFPPPDVNDLFDHTFATLPDDL

SEQ ID NO: 890 - protein, 329 aa, Bacillus halodurans C-125
QVLTPKGECQYEGSEFLDKTFVLSMYKQMINCREFDEKALKLQRQGRIGTYASFKGQEACQIGGALALRPTDWLFPTYRDHAAISTHGQPWHRIFLYWMGHMDGSLSPDDRNILPPAVPIATQMLHAVGTAWADKLKGNPHVSLVFFGDGATSEGDFHEALNFAGVYQTPTIFFCQNNGYAISVPFEKQSASKTIKQRSVAYDMRGERVDGNDIFAVYLTVKRAIEQARKGRGPTLIEAVTTRFGSHTTADDAKKYRDQEEIERTWKEMQDPLTRLKAYIQAKGWLSEEEEAQMKAKIRETIDEELSMAEQYPKPSISQMFEHVYENQP

SEQ ID NO: 891 - protein, 350 aa, Symbiobacterium thermophilum IAM 14863
RILQADGTLLEPVPAFLSVDQLKDVYRKMVYLRVFDQRCLNLQRQGRMGTFAPFSGQEASQVGSAYLLRPDRDWIFPTYRDHGAMHVMGVPLVNILRYFMGDEQGSHAPQGVNAFPISIPIATQLLHAVGAAWAGRIKGEDTVAVGYAGDGGTSPGDFHEALNFAAVFNVPVIFFIQNNRYAISTPNSRQFKTPTIAQRALGYDIAGVRVDGQDVLAVLAVMHEAIERARSGGGPTLVESVTFRYGPHTTSDDPKRYRSQEELEEWQARDPIERLRLYLVSQGQWSDSDDEALWTAAREQVAAAVAEAEAMPRPSVDDLFDYLYAEPTPNLVRQKEYLKAYLAKKEGGAR

SEQ ID NO: 892 - protein, 358 aa, Artificial
  Substituion in SEQ ID NO 885
MDDVQIYRFTGDTKPDQVLNEAGEMVGELPENAADLALEWYPFMIFCRKFDERAQLLQRQGRLGTYAPFRGQEAAQIASFAVLRPSDWVFPTYRELAGMMYHGLEPVHALLKSRGHPDAGRMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACEEEAEARVRQAVADMEAYPHKSLEEAARHVYAEVPEALALHLAKRGKEAR

SEQ ID NO: 893 - protein, 358 aa, Artificial
  Substituion in SEQ ID NO 885
MDDVQVYRFTGDTKPDQVLNEAGEMVGELPENAADLALEWYPFMIFCRKFDERAQILQRQGRLGTYAPFRGQEAAQIASFAVLRPSDWVFPTYRELAGMMYHGLEPVHALLKSRGHPDAGRMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACEEEAEARVRQAVADMEAYPHKSLEEAARHVYAEVPEALALHLAKRGKEAR

SEQ ID NO: 894 - protein, 358 aa, Artificial
  Substituion in SEQ ID NO 885
MDDVQVYRFTGDTKPDQVLNEAGEMVGELPENAADLALEWYPFMIFCRRFDERAQLLQRQGRLGTYAPFRGQEAAQIASFAVLRPSDWVFPTYRELAGMMYHGLEPVHALLKSRGHPDAGRMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACEEEAEARVRQAVADMEAYPHKSLEEAARHVYAEVPEALALHLAKRGKEAR

SEQ ID NO: 895 - protein, 358 aa, Artificial
  Substituion in SEQ ID NO 885
MDDVQVYRFTGDTKPDQVLNEAGEMVGELPENAADLALEWYPFMIFCRKFDERAQLLQRQGRLGTYAPFRGQEAAQIASFAVLRPSDWVFPTYRELAGMMYHGLEPVHALLKSRGHPDAGRMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRIGPHTTADDPGRYRDAVDVERWAAAKDPLVRLRLWLTRQGLWDDERQAACEEEAEARVRQAVADMEAYPHKSLEEAARHVYAEVPEALALHLAKRGKEAR

SEQ ID NO: 896 - protein, 358 aa, Artificial
  Substituion in SEQ ID NO 885
MDDVQVYRFTGDTKPDQVLNEAGEMVGELPENAADLALEWYPFMIFCRKFDERAQLLQRQGRLGTYAPFRGQEAAQIASFAVLRPSDWVFPTYRELAGMMYHGLEPVHALLKSRGHPDAGKMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACEEEAEARVRQAVADMEAYPHKSLEEAARHVYAEVPEALALHLAKRGKEAR

SEQ ID NO: 897 - DNA, 1077 bp, Artificial
  Substituion in SEQ ID NO 886
gtggatgacgtgcagatttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggccgcatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggaggccgcgcgccacgtgtacgccgaggtcccggaggcactcgcgcttcatctcgccaaacgcggaaaggaggcgcgctga

SEQ ID NO: 898 - DNA, 1077 bp, Artificial
  Substituion in SEQ ID NO 886
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaaattctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggccgcatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggaggccgcgcgccacgtgtacgccgaggtcccggaggcactcgcgcttcatctcgccaaacgcggaaaggaggcgcgctga

SEQ ID NO: 899 - DNA, 1077 bp, Artificial
  Substituion in SEQ ID NO 886
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgacgtttcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggccgcatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggaggccgcgcgccacgtgtacgccgaggtcccggaggcactcgcgcttcatctcgccaaacgcggaaaggaggcgcgctga

SEQ ID NO: 900 - DNA, 1077 bp, Artificial
  Substituion in SEQ ID NO 886
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggccgcatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcattggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggaggccgcgcgccacgtgtacgccgaggtcccggaggcactcgcgcttcatctcgccaaacgcggaaaggaggcgcgctga

SEQ ID NO: 901 - DNA, 1077 bp, Artificial
  Substituion in SEQ ID NO 886
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggcaaaatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggaggccgcgcgccacgtgtacgccgaggtcccggaggcactcgcgcttcatctcgccaaacgcggaaaggaggcgcgctga

SEQ ID NO: 902 - protein, 325 aa, Alicyclobacillus acidocaldarius
MPKWTMIEAIRDALAIALRDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFREEVPEGDYQVPLGRAAVRREGSDVTLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEDAWLPSVTRVVEAIERVMED

SEQ ID NO: 903 - DNA, 978 bp, Alicyclobacillus acidocaldarius
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagcgcgtcatggaagattga

SEQ ID NO: 904 - protein, 323 aa, Geobacillus kaustophilus HTA426
MAELTMIEAINEAMRQEMERDPRIIVLGEDVGENGGVFRATDGLLAQFGEGRVFDTPLAESGIIGTSIGLAINGMRPIAEIQFLGFVYQAMDQLAAQAARIRFRSAGRFSCPIVVRSPYGGGVRTPELHSDALEALFTHSPGLKVVMPSNPYDAKGLLISAIRDEDPVLFLEPMKLYRAFRMEVPEEPYTIPLGQARVVKEGDDVTIIAWGATVPLAAKVAAEMQAKGVNAEVIDLRCLQPLDIDTIITSVEKTGRVMIVHEAVKTGGFGAEVAALISERALFSLSAPIVRIAGYDTPYPVPSVEDDWLPNAERIAEGIETLL

SEQ ID NO: 905 - protein, 323 aa, Geobacillus thermodenitrificans NG80-2
MAELTMIEAINEAMRQEMERNSRVIVLGEDVGENGGVFRATDGLLEQFGSGRVFDTPLAESGIIGTSIGLAINGMRPIAEIQFLGFVYQAMDQLAAQAARIRFRSGGRFSCPIVVRSPYGGGVRTPELHSDALEALFTHSPGLKVVMPSNPYDAKGLLISAIRDDDPVLFFEPMKLYRAFRMEVPEEPYTIPLGQARIVKEGDDVTILTWGATVPLVAKLADEMRMRGVDAEVIDLRCLQPLDIDTIIASVEKTGRVMIVHEAVKTSGFGAEVAALISERALFSLSAPIVRIAGYDTPYPVPSVEDDWLPNPARIVEGIETLM

SEQ ID NO: 906 - protein, 320 aa, Exiguobacterium sibiricum 255-15
TLVQAVTDALRTKLTDDETTLVLGEDVGKNGGVFRATDGLQEEFGEDRIIDTPLSEAGIVGTSIGLAVNGFKPIVEIQFLGFIYPAYEQIMTHVSRIRMRTMGRYGVPMVIRAPYGAGIRAPEIHSDSTEALFTSMPGLKVVCPSTPYDAKGLLIAAIEDPDPVLFLESMRSYRAFKEPVPSEAYTIEIGKANCITEGQDVTLIAWGAMVQVAQKAATEAATRGISCEVIDLRTLYPLDRETISASVQKTGRAVIIHEAQATGGLGNDLLALINDTSFLYLRAPVARVTGFDVPVPLFALEDHYIPTPTRVLEAIQRTVD

SEQ ID NO: 907 - protein, 323 aa, Geobacillus thermodenitrificans NG80-2
MAQMTMVQAITDALRIELKNDPNVLIFGEDVGVNGGVFRATEGLQAEFGEERVFDTPLAESGIGGLAVGLALQGFRPVPEIQFFGFVYEVMDSISGQMARIRYRTGGRYHMPITVRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVM

SEQ ID NO: 908 - protein, 323 aa, Bacillus cereus ATCC 14579
MAQMTMIQAITDALRVEMKNDPNVLVFGEDVGVNGGVFRATEGLQAEFGEDRVMDTPLAESGIGGLAVGLALEGFRPVPEIQFFGFVYEVMDSISGQLARMRYRSGGRWTAPVTVRSPFGGGVHTPELHADSLEGLVAQQPGLKVVIPSTPYDAKGLLISAIRDNDPVIYLEHMKLYRSFRQEVPEGDYTIDLGKADIKREGTDVSVIAYGAMVHAALKAAEELEKEGISLEVVDLRTVQPLDIETIIASVEKTGRVVVVQEAQKQAGIAANVVAEINDRAILNLEAPVVRVAAADTVFPFSQAESVWLPNHKDIVEAVNKVM

SEQ ID NO: 909 - protein, 325 aa, Artificial
  Substituion in SEQ ID NO 902
MPKWTMIEAIRDALAIALRDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFREEVPEGDYQVPLGRAAVRREGSDVTLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEDAWLPSVTRVVEAIERVMEE

SEQ ID NO: 910 - protein, 325 aa, Artificial
  Substituion in SEQ ID NO 902
MPKWTMIEAIRDALAIALRDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFREEVPEGDYQVPLGRAAVRREGSDVTLVAWGPTVPVAESAAAQVASRGISCEVLDLRTLAPLDRSALKASVEKTGRAVIVHEAVKYAGLGAEIAASIMDLAFYHLRAPIERVAGLDTPYPPPALEDAWLPSVTRVVEAIERVMED

SEQ ID NO: 911 - protein, 325 aa, Artificial
  Substituion in SEQ ID NO 902
MPKWTMIEAIRDALAIALRDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFREEVPEGDYQVPLGRAAVRREGSDVTLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEDAWLPSVTRVVEAIEKVMED

SEQ ID NO: 912 - protein, 325 aa, Artificial
  Substituion in SEQ ID NO 902
MPKWTMIEAIRDALAIALRDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFREEVPEGDYQVPLGRAAVRREGSDVTLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEDAWLPSVTRVVEAIERVMDD

SEQ ID NO: 913 - protein, 325 aa, Artificial
  Substituion in SEQ ID NO 902
MPKWTMIEAIRDALAIALKDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFREEVPEGDYQVPLGRAAVRREGSDVTLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEDAWLPSVTRVVEAIERVMED

SEQ ID NO: 914 - DNA, 978 bp, Artificial
  Substituion in SEQ ID NO 903
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagcgcgtcatggaagaatga

SEQ ID NO: 915 - DNA, 978 bp, Artificial
  Substituion in SEQ ID NO 903
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgaaatatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagcgcgtcatggaagattga

SEQ ID NO: 916 - DNA, 978 bp, Artificial
  Substituion in SEQ ID NO 903
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagaaagtcatggaagattga

SEQ ID NO: 917 - DNA, 978 bp, Artificial
  Substituion in SEQ ID NO 903
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagcgcgtcatggatgattga

SEQ ID NO: 918 - DNA, 978 bp, Artificial
  Substituion in SEQ ID NO 903
atgcccaagtggacgatgatcgaggccattcgggatgcgctggccatcgcccttaaagacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagcgcgtcatggaagattga

SEQ ID NO: 919 - protein, 391 aa, Alicyclobacillus acidocaldarius
MKRMNIGNEAQFQIYQMRLTGQYGGDPLCISMEDWVARAREVLSPEAFWYLAGGSGRGETMRANEEAFAKWRIVPRVFRDVSVRDLSIELFGERLPYPVLLAPIGVQSILHADGEVAAVRGAAKVGLPYIVSSASTMPLETIAEKAPGATLWFQLYWSRDRDVAQSFVRRAEAAGCKALVVTLDTPMMAWRERDLERAYLPFLLGEGLGNYLSDPAFRAKLRRPPEEDPASAILLWTQIFGHPGLTCDDLDWLRETTDLPLLLKGILHPDDAEEAFRRGADGIIVSNHGGRQVDGAVPSLDALVAIRERVGREKVVLMDGGVRRGSDVVKALALGANAVLVGRLYAYGLAVDGERGVETVLRYLLADFDLTMALSGHRSLSTLDVRALARA

SEQ ID NO: 920 - DNA, 1176 bp, Alicyclobacillus acidocaldarius
gtgaagcggatgaacatcggcaacgaagcgcagtttcagatttatcagatgcggctcaccggccaatatggcggcgatccgctctgcatctcgatggaggactgggtcgcgcgagcgcgggaggtgttatcgccagaggcgttctggtatctcgcgggcggatcggggcggggcgagacgatgcgggcaaacgaggaggcgttcgccaagtggcggattgtgccccgcgtgttccgcgacgtgtcggttcgagacctgtccatcgagcttttcggcgagcggctgccttatcccgtgctcctcgcgcccatcggcgtgcagtccatcctgcacgccgatggggaggtggcggcggtgcggggcgccgcgaaggtgggacttccgtacatcgtgagttcggcatcgaccatgccacttgagaccatcgccgaaaaggcgcccggcgcgacactctggttccagctctactggtcgagggatcgagatgttgcccagagcttcgtgcgccgcgccgaggccgccggctgcaaggcgctcgtcgtcacgctcgacacacccatgatggcctggcgggagcgggatcttgagcgcgcgtacttgccttttttgctcggcgaaggactcgggaactatctctcggatccggcgtttcgcgcgaagctgcgccggcctcccgaggaagatccggcgagcgccatcctcctctggacgcaaattttcggccacccgggcctcacgtgtgacgatctcgactggctgcgggagacgacagatcttccgctcctcctgaaggggattctccatcccgacgacgccgaggaggcgtttcgccgcggagcggacggcatcatcgtttcgaaccacggcggccggcaggtggacggggccgtcccatcgctggacgcgctggtcgccatacgggaacgcgtcggccgcgagaaggtggtcctcatggacggcggtgtgcggcgcggctccgacgtggtgaaggcgcttgcgctcggtgcgaacgccgtgctggtgggccgactgtatgcctacggcctcgcggtcgacggcgagcgcggtgtggagaccgtgctgcggtatctcctcgcggacttcgatctcacgatggccctgtctggacaccgttcgctttcgacgctcgacgtacgcgcactcgcccgcgcgtag

SEQ ID NO: 921 - protein, 371 aa, Streptomyces avermitilis MA-4680
QYEIYLNGMTGAVPRLPTDLTRLEELTEQRLGPGPVGYVAGGAGNGSTARANRSALDRRRIVPRMLRDVHERDLSVEVLGRTLPAPLALAPVGVLSIMHPDAESAAARAAAAQGVPYILSSASSTPMERVAEAMGDAERWFQLYWAKDREVTRSFLNRAKAAGYTALFVTLDTPLLAWRPRDLDQAYLPFLHGVGTANYFTDPAFRAGLAKPVHEDPNAAVMHFVSMFADPGKTWPDLEFLRENWDGPIVLKGILHPDDARRAASAGMDGVVVSNHGGRQVAGSVAAADALPRVVEAAGDRLTVLFDSGIRTGDDIFKALALGARAVLVGRPYAYGLGLDGQAGVEHVVRCLLAEFDLTLALSGHAGPGTL

SEQ ID NO: 922 - protein, 370 aa, Streptomyces ambofaciens ATCC 23877
QYEIYLNGMTGAVPRLPTDLTRLEELAERRLGPGPVGYVAGSAGDGSAARANRAALDRRRIVPRMLRDVHRRDLSVEVLGRPLPAPLALAPVGVLSIMHPDAEPAAARAAAAQGVPYILSSASSTPMEQVAEAMGDAERWFQLYWPKDREVARSFLERARAAGYSALFVTLDTPLLSWRPRDLDQAYLPFLHGVGTANYFSDPAFRAGLAKPVHEDPNAAVMHFVGMFSDPAKTWPDLAFLRENWDGPIVLKGVLHPDDARMAADAGMDGVVVSNHGGRQVAGSVAAADALPRVVEAAGDRLTVLFDSGVRTGDDVFKALALGARAVLLGRPYAYGLGLDGQAGVEHVIRCLLAELDLTLALSGHSSPAT

SEQ ID NO: 923 - protein, 370 aa, Streptomyces coelicolor A3(2)
QYEIYLNGMTGAVPRLPTDLTRLEELTERRLGPGPFGYVAGSAGDGSTARANRAALARRRIVPRMLRDVHERDLRVEVLGRSLPAPLALAPVGVLSIMHPEAEPAAARAAAAQGVPYILSSASSTPMEEVAEAMGDAERWFQLYWPKDREVARSFLDRARAAGYTALFVTLDTPLLSWRPRDLDQAYLPFLHGVGTANYFSDPAFRAGLAKPVHEDPNAAVMHFVGMFSDPAKSWPDLAFLRENWDGPIVLKGVLHPDDARLAADAGMDGVVVSNHGGRQVAGSVAAADALPRVAEAVGDRLTVLFDSGVRTGDDVFKALALGARAVLLGRPYVYGLGLDGRPGVEHVIRCLLAELDLTLALSGHASPAT

SEQ ID NO: 924 - protein, 354 aa, Saccharopolyspora erythraea NRRL 2338
SMEEHARAVLPANAYGYVAGNAGVGATGRANRQAFDQWRLVPRMLRGATRRDLTVSLFGQRLAAPVLLAPIAAQTVVHPEGELAAVRGAADAGVPFVLSTGASHPLEDVAAAAGGQPRWFQLYWPAHRAVCESLVRRAEASGYSALVLTVDSPSFGYRPADLDNGYLPFLNGAGIANFVSDPEFQGGLPSDAGEREVVEHWARVFANPGLTWDDLPWLRSLTGLPIVIKGVLHADDARRAVELGADGLVVSNHGGRQLDGSVASLDALPAVRAAVGDGVPVLLDSGVRTGSDVVKALALGADAVLYGRPYVYGLALDGQEGVSHVLRCLLAELDLALALTGSGAVSEITADLLA

SEQ ID NO: 925 - protein, 358 aa, Haloquadratum walsbyi DSM 16790
VSFSDLREEAFEEMSWKAKAYVHGGAGTEETFERNKDFSRWRIIPRMLRGVADRDLSTTVLGNEHSYPLMITPLGVQSLLHDDGEIATARACAEMDVPFVLSSLSSATMEDVAEALGDTPKWFQYYWASDRDVATSFLDRAETAGYDAIVVTVDAPTLGWRDRLLEKGYYPFLEGEGIGNYFSDPAFRDSLARPPEEDPEAAVDRFLSIFGDASLTWDDLAFVREQTDLPIIIKGVLHPDDARRAVEAGADAVQVSTHGGRQVDGSIAAIEALPEIAEAVGDETTVLFDSGIRRGAQAFKALALGADTVLLGRPFAYGLAHSGQEGVEQVLENTLSQIDLTMGLAGIDDVDDIDRSAV

SEQ ID NO: 926 - protein, 391 aa, Artificial
  Substituion in SEQ ID NO 919
MKRMNIGNEAQFQIYQMRLTGQYGGDPLCISMEDWVARAREVLSPEAFWYLAGGSGRGETMRANEEAFAKWRIVPRVFRDVSVRDLSIELFGERLPYPVLLAPIGVQSILHADGEVAAVRGAAKVGLPYIVSSASTMPLETIAEKAPGATLWFQLYWSRDRDVAQSFVRRAEAAGCKALVVTLDTPMMAWRERDLERAYLPFLLGEGLGNYLSDPAFRAKLRRPPEEDPASAILLWTQIFGHPGLTCDDLDWLRETTDLPLLLKGILHPDDAEEAFRRGADGIIVSNHGGRQVDGAVPSLDALVAIRERVGREKVVLMDGGVRRGSDVVKALALGANAVLVGRLYAYGLAVDGERGVETVLRYLLADFDLTMALSGHRSLSTLDVRAIARA

SEQ ID NO: 927 - protein, 391 aa, Artificial
  Substituion in SEQ ID NO 919
MKRMNIGNEAQFQIYQMRLTGQYGGDPLCISMEDWVARAREVLSPEAFWYLAGGSGRGETMRANEEAFAKWRIVPRVFRDVSVRDLSIELFGERLPYPVLLAPIGVQSILHADGEVAAVRGAAKIGLPYIVSSASTMPLETIAEKAPGATLWFQLYWSRDRDVAQSFVRRAEAAGCKALVVTLDTPMMAWRERDLERAYLPFLLGEGLGNYLSDPAFRAKLRRPPEEDPASAILLWTQIFGHPGLTCDDLDWLRETTDLPLLLKGILHPDDAEEAFRRGADGIIVSNHGGRQVDGAVPSLDALVAIRERVGREKVVLMDGGVRRGSDVVKALALGANAVLVGRLYAYGLAVDGERGVETVLRYLLADFDLTMALSGHRSLSTLDVRALARA

SEQ ID NO: 928 - protein, 391 aa, Artificial
  Substituion in SEQ ID NO 919
MKRMNIGNEAQFQIYQMRLTGQYGGDPLCISMEDWVARAREVLSPEAFWYLAGGSGRGETMRANEEAFAKWRIVPRVFRDVSVRDLSIELFGERLPYPVLLAPIGVQSILHADGEVAAVRGAAKVGLPYIVSSASTMPLETIAEKAPGATLWFQLYWSRDRDVAQSFVKRAEAAGCKALVVTLDTPMMAWRERDLERAYLPFLLGEGLGNYLSDPAFRAKLRRPPEEDPASAILLWTQIFGHPGLTCDDLDWLRETTDLPLLLKGILHPDDAEEAFRRGADGIIVSNHGGRQVDGAVPSLDALVAIRERVGREKVVLMDGGVRRGSDVVKALALGANAVLVGRLYAYGLAVDGERGVETVLRYLLADFDLTMALSGHRSLSTLDVRALARA

SEQ ID NO: 929 - protein, 391 aa, Artificial
  Substituion in SEQ ID NO 919
MKRMNIGNEAQFQIYQMRLTGQYGGDPLCISMEDWVARAREVLSPEAFWYLAGGSGRGETMRANEEAFAKWRIVPRVFRDVSVRDLSIELFGERLPYPVLLAPIGVQSILHADGEVAAVRGAAKVGLPYIVSSASTMPLETIAEKAPGATLWFQLYWSRDRDVAQSFVRRAEAAGCKALVVTLDTPMMAWRERDLERAYLPFLLGEGLGNYLSDPAFRAKLRRPPEEDPASAILLWTQIFGHPGLTCDDLDWLRETTDLPLLLKGILHPDDAEEAFRRGADGIIVSNHGGRQVDGAVPSLDALVAIKERVGREKVVLMDGGVRRGSDVVKALALGANAVLVGRLYAYGLAVDGERGVETVLRYLLADFDLTMALSGHRSLSTLDVRALARA

SEQ ID NO: 930 - protein, 391 aa, Artificial
  Substituion in SEQ ID NO 919
MKRMNIGNEAQFQIYQMRLTGQYGGDPLCISMEDWVARAREVLSPEAFWYLAGGSGRGETMRANEEAFAKWRIVPRVFRDVSVRDLSIELFGERLPYPVLLAPIGVQSILHADGEVAAVRGAAKVGLPYIVSSASTMPLETIAEKAPGATLWFQLYWSRDRDVANSFVRRAEAAGCKALVVTLDTPMMAWRERDLERAYLPFLLGEGLGNYLSDPAFRAKLRRPPEEDPASAILLWTQIFGHPGLTCDDLDWLRETTDLPLLLKGILHPDDAEEAFRRGADGIIVSNHGGRQVDGAVPSLDALVAIRERVGREKVVLMDGGVRRGSDVVKALALGANAVLVGRLYAYGLAVDGERGVETVLRYLLADFDLTMALSGHRSLSTLDVRALARA

SEQ ID NO: 931 - DNA, 1176 bp, Artificial
  Substituion in SEQ ID NO 920
gtgaagcggatgaacatcggcaacgaagcgcagtttcagatttatcagatgcggctcaccggccaatatggcggcgatccgctctgcatctcgatggaggactgggtcgcgcgagcgcgggaggtgttatcgccagaggcgttctggtatctcgcgggcggatcggggcggggcgagacgatgcgggcaaacgaggaggcgttcgccaagtggcggattgtgccccgcgtgttccgcgacgtgtcggttcgagacctgtccatcgagcttttcggcgagcggctgccttatcccgtgctcctcgcgcccatcggcgtgcagtccatcctgcacgccgatggggaggtggcggcggtgcggggcgccgcgaaggtgggacttccgtacatcgtgagttcggcatcgaccatgccacttgagaccatcgccgaaaaggcgcccggcgcgacactctggttccagctctactggtcgagggatcgagatgttgcccagagcttcgtgcgccgcgccgaggccgccggctgcaaggcgctcgtcgtcacgctcgacacacccatgatggcctggcgggagcgggatcttgagcgcgcgtacttgccttttttgctcggcgaaggactcgggaactatctctcggatccggcgtttcgcgcgaagctgcgccggcctcccgaggaagatccggcgagcgccatcctcctctggacgcaaattttcggccacccgggcctcacgtgtgacgatctcgactggctgcgggagacgacagatcttccgctcctcctgaaggggattctccatcccgacgacgccgaggaggcgtttcgccgcggagcggacggcatcatcgtttcgaaccacggcggccggcaggtggacggggccgtcccatcgctggacgcgctggtcgccatacgggaacgcgtcggccgcgagaaggtggtcctcatggacggcggtgtgcggcgcggctccgacgtggtgaaggcgcttgcgctcggtgcgaacgccgtgctggtgggccgactgtatgcctacggcctcgcggtcgacggcgagcgcggtgtggagaccgtgctgcggtatctcctcgcggacttcgatctcacgatggccctgtctggacaccgttcgctttcgacgctcgacgtacgcgcaattgcccgcgcgtag

SEQ ID NO: 932 - DNA, 1176 bp, Artificial
  Substituion in SEQ ID NO 920
gtgaagcggatgaacatcggcaacgaagcgcagtttcagatttatcagatgcggctcaccggccaatatggcggcgatccgctctgcatctcgatggaggactgggtcgcgcgagcgcgggaggtgttatcgccagaggcgttctggtatctcgcgggcggatcggggcggggcgagacgatgcgggcaaacgaggaggcgttcgccaagtggcggattgtgccccgcgtgttccgcgacgtgtcggttcgagacctgtccatcgagcttttcggcgagcggctgccttatcccgtgctcctcgcgcccatcggcgtgcagtccatcctgcacgccgatggggaggtggcggcggtgcggggcgccgcgaagattggacttccgtacatcgtgagttcggcatcgaccatgccacttgagaccatcgccgaaaaggcgcccggcgcgacactctggttccagctctactggtcgagggatcgagatgttgcccagagcttcgtgcgccgcgccgaggccgccggctgcaaggcgctcgtcgtcacgctcgacacacccatgatggcctggcgggagcgggatcttgagcgcgcgtacttgccttttttgctcggcgaaggactcgggaactatctctcggatccggcgtttcgcgcgaagctgcgccggcctcccgaggaagatccggcgagcgccatcctcctctggacgcaaattttcggccacccgggcctcacgtgtgacgatctcgactggctgcgggagacgacagatcttccgctcctcctgaaggggattctccatcccgacgacgccgaggaggcgtttcgccgcggagcggacggcatcatcgtttcgaaccacggcggccggcaggtggacggggccgtcccatcgctggacgcgctggtcgccatacgggaacgcgtcggccgcgagaaggtggtcctcatggacggcggtgtgcggcgcggctccgacgtggtgaaggcgcttgcgctcggtgcgaacgccgtgctggtgggccgactgtatgcctacggcctcgcggtcgacggcgagcgcggtgtggagaccgtgctgcggtatctcctcgcggacttcgatctcacgatggccctgtctggacaccgttcgctttcgacgctcgacgtacgcgcactcgcccgcgcgtag

SEQ ID NO: 933 - DNA, 1176 bp, Artificial
  Substituion in SEQ ID NO 920
gtgaagcggatgaacatcggcaacgaagcgcagtttcagatttatcagatgcggctcaccggccaatatggcggcgatccgctctgcatctcgatggaggactgggtcgcgcgagcgcgggaggtgttatcgccagaggcgttctggtatctcgcgggcggatcggggcggggcgagacgatgcgggcaaacgaggaggcgttcgccaagtggcggattgtgccccgcgtgttccgcgacgtgtcggttcgagacctgtccatcgagcttttcggcgagcggctgccttatcccgtgctcctcgcgcccatcggcgtgcagtccatcctgcacgccgatggggaggtggcggcggtgcggggcgccgcgaaggtgggacttccgtacatcgtgagttcggcatcgaccatgccacttgagaccatcgccgaaaaggcgcccggcgcgacactctggttccagctctactggtcgagggatcgagatgttgcccagagcttcgtgaaacgcgccgaggccgccggctgcaaggcgctcgtcgtcacgctcgacacacccatgatggcctggcgggagcgggatcttgagcgcgcgtacttgccttttttgctcggcgaaggactcgggaactatctctcggatccggcgtttcgcgcgaagctgcgccggcctcccgaggaagatccggcgagcgccatcctcctctggacgcaaattttcggccacccgggcctcacgtgtgacgatctcgactggctgcgggagacgacagatcttccgctcctcctgaaggggattctccatcccgacgacgccgaggaggcgtttcgccgcggagcggacggcatcatcgtttcgaaccacggcggccggcaggtggacggggccgtcccatcgctggacgcgctggtcgccatacgggaacgcgtcggccgcgagaaggtggtcctcatggacggcggtgtgcggcgcggctccgacgtggtgaaggcgcttgcgctcggtgcgaacgccgtgctggtgggccgactgtatgcctacggcctcgcggtcgacggcgagcgcggtgtggagaccgtgctgcggtatctcctcgcggacttcgatctcacgatggccctgtctggacaccgttcgctttcgacgctcgacgtacgcgcactcgcccgcgcgtag

SEQ ID NO: 934 - DNA, 1176 bp, Artificial
  Substituion in SEQ ID NO 920
gtgaagcggatgaacatcggcaacgaagcgcagtttcagatttatcagatgcggctcaccggccaatatggcggcgatccgctctgcatctcgatggaggactgggtcgcgcgagcgcgggaggtgttatcgccagaggcgttctggtatctcgcgggcggatcggggcggggcgagacgatgcgggcaaacgaggaggcgttcgccaagtggcggattgtgccccgcgtgttccgcgacgtgtcggttcgagacctgtccatcgagcttttcggcgagcggctgccttatcccgtgctcctcgcgcccatcggcgtgcagtccatcctgcacgccgatggggaggtggcggcggtgcggggcgccgcgaaggtgggacttccgtacatcgtgagttcggcatcgaccatgccacttgagaccatcgccgaaaaggcgcccggcgcgacactctggttccagctctactggtcgagggatcgagatgttgcccagagcttcgtgcgccgcgccgaggccgccggctgcaaggcgctcgtcgtcacgctcgacacacccatgatggcctggcgggagcgggatcttgagcgcgcgtacttgccttttttgctcggcgaaggactcgggaactatctctcggatccggcgtttcgcgcgaagctgcgccggcctcccgaggaagatccggcgagcgccatcctcctctggacgcaaattttcggccacccgggcctcacgtgtgacgatctcgactggctgcgggagacgacagatcttccgctcctcctgaaggggattctccatcccgacgacgccgaggaggcgtttcgccgcggagcggacggcatcatcgtttcgaaccacggcggccggcaggtggacggggccgtcccatcgctggacgcgctggtcgccataaaagaacgcgtcggccgcgagaaggtggtcctcatggacggcggtgtgcggcgcggctccgacgtggtgaaggcgcttgcgctcggtgcgaacgccgtgctggtgggccgactgtatgcctacggcctcgcggtcgacggcgagcgcggtgtggagaccgtgctgcggtatctcctcgcggacttcgatctcacgatggccctgtctggacaccgttcgctttcgacgctcgacgtacgcgcactcgcccgcgcgtag

SEQ ID NO: 935 - DNA, 1176 bp, Artificial
  Substituion in SEQ ID NO 920
gtgaagcggatgaacatcggcaacgaagcgcagtttcagatttatcagatgcggctcaccggccaatatggcggcgatccgctctgcatctcgatggaggactgggtcgcgcgagcgcgggaggtgttatcgccagaggcgttctggtatctcgcgggcggatcggggcggggcgagacgatgcgggcaaacgaggaggcgttcgccaagtggcggattgtgccccgcgtgttccgcgacgtgtcggttcgagacctgtccatcgagcttttcggcgagcggctgccttatcccgtgctcctcgcgcccatcggcgtgcagtccatcctgcacgccgatggggaggtggcggcggtgcggggcgccgcgaaggtgggacttccgtacatcgtgagttcggcatcgaccatgccacttgagaccatcgccgaaaaggcgcccggcgcgacactctggttccagctctactggtcgagggatcgagatgttgccaatagcttcgtgcgccgcgccgaggccgccggctgcaaggcgctcgtcgtcacgctcgacacacccatgatggcctggcgggagcgggatcttgagcgcgcgtacttgccttttttgctcggcgaaggactcgggaactatctctcggatccggcgtttcgcgcgaagctgcgccggcctcccgaggaagatccggcgagcgccatcctcctctggacgcaaattttcggccacccgggcctcacgtgtgacgatctcgactggctgcgggagacgacagatcttccgctcctcctgaaggggattctccatcccgacgacgccgaggaggcgtttcgccgcggagcggacggcatcatcgtttcgaaccacggcggccggcaggtggacggggccgtcccatcgctggacgcgctggtcgccatacgggaacgcgtcggccgcgagaaggtggtcctcatggacggcggtgtgcggcgcggctccgacgtggtgaaggcgcttgcgctcggtgcgaacgccgtgctggtgggccgactgtatgcctacggcctcgcggtcgacggcgagcgcggtgtggagaccgtgctgcggtatctcctcgcggacttcgatctcacgatggccctgtctggacaccgttcgctttcgacgctcgacgtacgcgcactcgcccgcgcgtag

SEQ ID NO: 936 - protein, 467 aa, Alicyclobacillus acidocaldarius
MNKGYVVQVMGPVVDVRFPEGQLPAINNALRIDYEGDLPVHLTLEVALHLGDNVVRTIAMSSTDGLVRGVEVVDTGQPISMPVGPGTLGRIFNVLGETIDERGPVDAPERWPIHRPAPAFGDLTTKTEIFETGIKVVDLLAPYVKGGKVGLFGGAGVGKTVLIQELIHNIAKEHGGYSVFAGVGERTREGNDLYHEMKESGVLDKTCMVFGQMNEPPGARLRVALSGLTLAEYFRDVEQRDVLFFIDNIFRFTQAGSEVSALLGRMPSAVGYQPTLATEMGQLQERIASTVRGSITSIQAVYVPADDYTDPAPANTFTHLDATTVLERRIADMGLYPAVDPLASTSRALQPDIVGEEHYQVARGVQAVLQRYRELQDIIAILGMDELTDEDRLIVSRARKIQNFLSQPFFVAEVFTGTPGKYVPVKDTVRSFKEILEGKHDDIPETYFRYCGAIEDVIEKARKDGYA

SEQ ID NO: 937 - DNA, 1404 bp, Alicyclobacillus acidocaldarius
gtgaacaaagggtatgtagtgcaggtcatgggcccggtggtcgatgtccgctttccagaaggacaactgccggcgatcaacaacgccctccgcattgattacgagggcgatctgcccgtgcatctgacgctcgaggtggcgctgcacctcggagacaacgtggttcgaaccatcgcgatgtcgtcgacggacgggctcgtccgcggcgtcgaagtcgtcgatacagggcagcccatctcgatgcccgtaggaccgggcaccctggggcgcatcttcaacgtgctcggcgagacgattgacgagagggggcccgtcgatgccccggagcgctggccgatccaccgtcccgcgcccgcgtttggggatctgacgacgaagaccgagatcttcgaaaccggcatcaaggtcgtggatctgctcgctccgtacgtcaagggcggtaaggttggcctgttcggcggcgcgggcgtcggcaaaacggtgctcattcaggagctcattcacaacatcgcgaaggagcacggcggttattcggtgttcgccggcgtcggcgagcggacgcgcgagggtaacgacctctaccatgaaatgaaggagtcgggcgtcctcgacaagacgtgcatggtgttcggccagatgaacgagccgcccggtgcgcgcctccgcgtggcgctgtccggcctgacgctcgctgagtacttccgcgatgtggagcagcgcgacgtcctgttcttcatcgacaacatcttccgcttcacacaggcgggttccgaggtgtctgcgcttctcggccgcatgccgtcggccgtcggttaccagcccaccctggccacggaaatgggccaactgcaggaacgcattgcctcgacggtgcgagggtccatcacgtccatccaggcggtgtacgtgccggcggacgactacaccgatccggcgccggccaacacgttcacccacctcgatgccacgaccgtgttggagcgccggatcgccgacatgggcctgtatccggcggtcgatccgctcgcttcgacgtcgcgggcgctccagcctgacatcgtgggtgaggagcactatcaggtggcgcgtggcgtccaagcggtgctgcagcggtatcgcgagctgcaggacatcatcgccatcctcggcatggacgagctgacggatgaggaccgcctcatcgtgtcgcgcgcgcgcaaaatccagaacttcctgtcgcagccgttcttcgtcgctgaggtgttcaccgggacgccgggcaagtacgtgccggtgaaggataccgtgcgctcgttcaaggagatcctggagggcaagcacgacgacattccggagacgtacttccgctactgcggcgcgattgaagacgtgatcgagaaggcgcgcaaggacggctacgcctga

SEQ ID NO: 938 - protein, 461 aa, Bacillus sp. TA2.A1
MNKGRIIQVMGPVVDIQFESGQLPDIYNAITIERPQGGTLTVEAAVHLGDNVVRCVAMASTDGLVRGLEAVDTGAPISVPVGKATLGRVFNVLGEPIDEQGEVNAEERHPIHRPAPEFEELSTADEILETGIKVIDLLAPYAKGGKIGLFGGAGVGKTVLIQELINNVAQEHGGLSVFAGVGERTREGNDLYHEMKDSGVISKTSMVFGQMNEPPGARLRVALTGLTMAEYFRDREGQDVLLFIDNIFRFTQAGSEVSALLGRMPSAVGYQPTLATEMGQLQERITSTKKGSITSIQAIYVPADDYTDPAPATTFAHLDATTNLERKLAEMGIYPAVDPLASTSRILSPAVVGEEHYRVARGVQQVLQRYNDLQDIIAILGMDELSDEDKLIVARARKIQRFLSQPFHVAEQFTGMPGKYVPVKETVRGFKEILEGKHDNLPEEAFYMVGTIDEAVEKAKK

SEQ ID NO: 939 - protein, 470 aa, Geobacillus thermoleovorans
MTRGRVIQVMGPVVDVKFENGHLPAIYNALKIQHKARNENEVDIDLTLEVALHLGDDTVRTIAMASTDGLIRGMEVIDTGAPISVPVGEVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAVGYQPTLATEMGQLQERITSTAKGSITSIQAIYVPADDYTDPAPATTFSHLDATTNLERKLAEMGIYPAVDPLASTSRALAPEIVGEEHYQVARKVQQTLQRYKELQDIIAILGMDELSDEDKLVVHRARRIQFFLSQNFHVAEQFTGQPGSYVPVKETVRGFKEILEGKYDHLPEDRFRLVGRIEDVVEKAKAMG

SEQ ID NO: 940 - protein, 470 aa, Geobacillus kaustophilus HTA426
MTRGRVIQVMGPVVDVKFENGHLPAIYNALKIQHKARNENEVDIDLTLEVALHLGDDTVRTIAMASTDGLIRGMEVIDTGAPISVPVGEVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAVGYQPTLATEMGQLQERITSTAKGSITSIQAIYVPADDYTDPAPATTFSHLDATTNLERKLAEMGIYPAVDPLASTSRALAPEIVGEEHYQVARKVQQTLQRYKELQDIIAILGMDELSDEDKLVVHRARRIQFFLSQNFHVAEQFTGQPGSYVPVKETVRGFKEILEGKYDHLPEDAFRLVGRIEEVVEKAKAMG

SEQ ID NO: 941 - protein, 470 aa, Bacillus caldotenax
MTRGRVIQVMGPVVDVKFENGHLPAIYNALKIQHKARNENEVDIDLTLEVALHLGDDTVRTIAMASTDGLIRGMEVIDTGAPISVPVGEVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAVGYQPTLATEMGQLQERITSTAKGSTTSIQAIYVPADDYTDPAPATTFSHLDATTNLERNVAEMGIYPAVDPLASTSRALAPEIVGEEHYQVARKVQQTLQRYKELQDIIAILGMDELSDEDKLVVHRARRIQFFLSQNFHVAEQFTGQPGSYVPVKETVRGFKEILEGKYDHLPEDRFRLVGRIEEVVEKAKAMG

SEQ ID NO: 942 - protein, 470 aa, ATPase beta F1 Score: 674 Significance: 0.0 Identities: 344/470 Positives: 391/470 Gaps: 5/470
MTRGRVIQVMGPVVDVKFENGHLPAIYNALKIQHKARNENEVDIDLTLEVALHLGDDTVRTIAMASTDGLIRGMEVIDTGAPISVPVGQVTLGRVFNVLGEPIDLEGDIPADARRDPIHRPAPKFEELATEVEILETGIKVVDLLAPYIKGGKIGLFGGAGDGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAIGYQPTLATEMGQLQERITSTAKGSITSIQAIYVPADDYTDPAPATTFSHLDATTNLERKLAEMGIYPAVDPLVSTSRALAPEIVGEEHYQVARKVQQTLERYKELQDIIAILGMDELSDEDKLVVHRARRIQFFLSQNFHVAEQFTGQPGSYVPVKETVRGFKEILEGKYDHLPEDRFRLVGRIEEVVEKAKAMG

SEQ ID NO: 943 - protein, 467 aa, Artificial
  Substituion in SEQ ID NO 936
MNKGYVVQVMGPVVDVRFPEGQLPAINNALRIDYEGDLPVHLTLEVALHLGDNVVRTIAMSSTDGLVRGVEVVDTGQPISMPVGPGTLGRIFNVLGETIDERGPVEAPERWPIHRPAPAFGDLTTKTEIFETGIKVVDLLAPYVKGGKVGLFGGAGVGKTVLIQELIHNIAKEHGGYSVFAGVGERTREGNDLYHEMKESGVLDKTCMVFGQMNEPPGARLRVALSGLTLAEYFRDVEQRDVLFFIDNIFRFTQAGSEVSALLGRMPSAVGYQPTLATEMGQLQERIASTVRGSITSIQAVYVPADDYTDPAPANTFTHLDATTVLERRIADMGLYPAVDPLASTSRALQPDIVGEEHYQVARGVQAVLQRYRELQDIIAILGMDELTDEDRLIVSRARKIQNFLSQPFFVAEVFTGTPGKYVPVKDTVRSFKEILEGKHDDIPETYFRYCGAIEDVIEKARKDGYA

SEQ ID NO: 944 - protein, 467 aa, Artificial
  Substituion in SEQ ID NO 936
MNKGYVVQVMGPVVDVRFPEGQLPAINNALRIDYEGDLPVHLTLEVALHLGDNVVRTIAMSSTDGLVRGVEVVDTGNPISMPVGPGTLGRIFNVLGETIDERGPVDAPERWPIHRPAPAFGDLTTKTEIFETGIKVVDLLAPYVKGGKVGLFGGAGVGKTVLIQELIHNIAKEHGGYSVFAGVGERTREGNDLYHEMKESGVLDKTCMVFGQMNEPPGARLRVALSGLTLAEYFRDVEQRDVLFFIDNIFRFTQAGSEVSALLGRMPSAVGYQPTLATEMGQLQERIASTVRGSITSIQAVYVPADDYTDPAPANTFTHLDATTVLERRIADMGLYPAVDPLASTSRALQPDIVGEEHYQVARGVQAVLQRYRELQDIIAILGMDELTDEDRLIVSRARKIQNFLSQPFFVAEVFTGTPGKYVPVKDTVRSFKEILEGKHDDIPETYFRYCGAIEDVIEKARKDGYA

SEQ ID NO: 945 - protein, 467 aa, Artificial
  Substituion in SEQ ID NO 936
MNKGYVVQVMGPVVDVRFPEGQLPAINNALRIDYEGDLPVHLTLEVALHLGDNVVRTIAMSSTDGLVRGVEVVDTGQPISMPVGPGTLGRIFNVLGETIDERGPVDAPERWPIHRPAPAFGDLTTKTEIFETGIKVVDLLAPYIKGGKVGLFGGAGVGKTVLIQELIHNIAKEHGGYSVFAGVGERTREGNDLYHEMKESGVLDKTCMVFGQMNEPPGARLRVALSGLTLAEYFRDVEQRDVLFFIDNIFRFTQAGSEVSALLGRMPSAVGYQPTLATEMGQLQERIASTVRGSITSIQAVYVPADDYTDPAPANTFTHLDATTVLERRIADMGLYPAVDPLASTSRALQPDIVGEEHYQVARGVQAVLQRYRELQDIIAILGMDELTDEDRLIVSRARKIQNFLSQPFFVAEVFTGTPGKYVPVKDTVRSFKEILEGKHDDIPETYFRYCGAIEDVIEKARKDGYA

SEQ ID NO: 946 - protein, 467 aa, Artificial
  Substituion in SEQ ID NO 936
MNKGYVVQVMGPVVDVRFPEGQLPAINNALRIDYEGDLPVHLTLEVALHLGDNVVRTIAMSSTDGLVRGVEVVDTGQPISMPVGPGTLGRIFNVLGETIDERGPVDAPERWPIHRPAPAFGDLTTKTEIFETGIKVVDLLAPYVKGGKVGLFGGAGVGKTVLIQELIHNIAKEHGGYSVFAGVGERTREGNDLYHEMKESGVLDKTCMVFGQMNEPPGARLRVALSGLTLAEYFRDVEQRDVLFFIDNIFRFTQAGSEVSALLGRMPSAVGYQPTLATEMGQLQERIASTVRGSITSIQAVYVPADDYTDPAPANTFTHLDATTVLERRIADMGLYPAVDPLASTSRALQPDIVGEEHYQVARGVQAVLQRYRELQDIIAILGMDELTDEDRLIVSRARKIQNFLSQPFFVAEVFTGTPGKYVPVKDTVRSFKEILEGKHDDIPETYFRYCGAIEDVIEKARKEGYA

SEQ ID NO: 947 - protein, 467 aa, Artificial
  Substituion in SEQ ID NO 936
MNKGYVVQVMGPVVDVRFPEGQLPAINNALRIDYEGELPVHLTLEVALHLGDNVVRTIAMSSTDGLVRGVEVVDTGQPISMPVGPGTLGRIFNVLGETIDERGPVDAPERWPIHRPAPAFGDLTTKTEIFETGIKVVDLLAPYVKGGKVGLFGGAGVGKTVLIQELIHNIAKEHGGYSVFAGVGERTREGNDLYHEMKESGVLDKTCMVFGQMNEPPGARLRVALSGLTLAEYFRDVEQRDVLFFIDNIFRFTQAGSEVSALLGRMPSAVGYQPTLATEMGQLQERIASTVRGSITSIQAVYVPADDYTDPAPANTFTHLDATTVLERRIADMGLYPAVDPLASTSRALQPDIVGEEHYQVARGVQAVLQRYRELQDIIAILGMDELTDEDRLIVSRARKIQNFLSQPFFVAEVFTGTPGKYVPVKDTVRSFKEILEGKHDDIPETYFRYCGAIEDVIEKARKDGYA

SEQ ID NO: 948 - DNA, 1404 bp, Artificial
  Substituion in SEQ ID NO 937
gtgaacaaagggtatgtagtgcaggtcatgggcccggtggtcgatgtccgctttccagaaggacaactgccggcgatcaacaacgccctccgcattgattacgagggcgatctgcccgtgcatctgacgctcgaggtggcgctgcacctcggagacaacgtggttcgaaccatcgcgatgtcgtcgacggacgggctcgtccgcggcgtcgaagtcgtcgatacagggcagcccatctcgatgcccgtaggaccgggcaccctggggcgcatcttcaacgtgctcggcgagacgattgacgagagggggcccgtcgaagccccggagcgctggccgatccaccgtcccgcgcccgcgtttggggatctgacgacgaagaccgagatcttcgaaaccggcatcaaggtcgtggatctgctcgctccgtacgtcaagggcggtaaggttggcctgttcggcggcgcgggcgtcggcaaaacggtgctcattcaggagctcattcacaacatcgcgaaggagcacggcggttattcggtgttcgccggcgtcggcgagcggacgcgcgagggtaacgacctctaccatgaaatgaaggagtcgggcgtcctcgacaagacgtgcatggtgttcggccagatgaacgagccgcccggtgcgcgcctccgcgtggcgctgtccggcctgacgctcgctgagtacttccgcgatgtggagcagcgcgacgtcctgttcttcatcgacaacatcttccgcttcacacaggcgggttccgaggtgtctgcgcttctcggccgcatgccgtcggccgtcggttaccagcccaccctggccacggaaatgggccaactgcaggaacgcattgcctcgacggtgcgagggtccatcacgtccatccaggcggtgtacgtgccggcggacgactacaccgatccggcgccggccaacacgttcacccacctcgatgccacgaccgtgttggagcgccggatcgccgacatgggcctgtatccggcggtcgatccgctcgcttcgacgtcgcgggcgctccagcctgacatcgtgggtgaggagcactatcaggtggcgcgtggcgtccaagcggtgctgcagcggtatcgcgagctgcaggacatcatcgccatcctcggcatggacgagctgacggatgaggaccgcctcatcgtgtcgcgcgcgcgcaaaatccagaacttcctgtcgcagccgttcttcgtcgctgaggtgttcaccgggacgccgggcaagtacgtgccggtgaaggataccgtgcgctcgttcaaggagatcctggagggcaagcacgacgacattccggagacgtacttccgctactgcggcgcgattgaagacgtgatcgagaaggcgcgcaaggacggctacgcctga

SEQ ID NO: 949 - DNA, 1404 bp, Artificial
  Substituion in SEQ ID NO 937
gtgaacaaagggtatgtagtgcaggtcatgggcccggtggtcgatgtccgctttccagaaggacaactgccggcgatcaacaacgccctccgcattgattacgagggcgatctgcccgtgcatctgacgctcgaggtggcgctgcacctcggagacaacgtggttcgaaccatcgcgatgtcgtcgacggacgggctcgtccgcggcgtcgaagtcgtcgatacagggaatcccatctcgatgcccgtaggaccgggcaccctggggcgcatcttcaacgtgctcggcgagacgattgacgagagggggcccgtcgatgccccggagcgctggccgatccaccgtcccgcgcccgcgtttggggatctgacgacgaagaccgagatcttcgaaaccggcatcaaggtcgtggatctgctcgctccgtacgtcaagggcggtaaggttggcctgttcggcggcgcgggcgtcggcaaaacggtgctcattcaggagctcattcacaacatcgcgaaggagcacggcggttattcggtgttcgccggcgtcggcgagcggacgcgcgagggtaacgacctctaccatgaaatgaaggagtcgggcgtcctcgacaagacgtgcatggtgttcggccagatgaacgagccgcccggtgcgcgcctccgcgtggcgctgtccggcctgacgctcgctgagtacttccgcgatgtggagcagcgcgacgtcctgttcttcatcgacaacatcttccgcttcacacaggcgggttccgaggtgtctgcgcttctcggccgcatgccgtcggccgtcggttaccagcccaccctggccacggaaatgggccaactgcaggaacgcattgcctcgacggtgcgagggtccatcacgtccatccaggcggtgtacgtgccggcggacgactacaccgatccggcgccggccaacacgttcacccacctcgatgccacgaccgtgttggagcgccggatcgccgacatgggcctgtatccggcggtcgatccgctcgcttcgacgtcgcgggcgctccagcctgacatcgtgggtgaggagcactatcaggtggcgcgtggcgtccaagcggtgctgcagcggtatcgcgagctgcaggacatcatcgccatcctcggcatggacgagctgacggatgaggaccgcctcatcgtgtcgcgcgcgcgcaaaatccagaacttcctgtcgcagccgttcttcgtcgctgaggtgttcaccgggacgccgggcaagtacgtgccggtgaaggataccgtgcgctcgttcaaggagatcctggagggcaagcacgacgacattccggagacgtacttccgctactgcggcgcgattgaagacgtgatcgagaaggcgcgcaaggacggctacgcctga

SEQ ID NO: 950 - DNA, 1404 bp, Artificial
  Substituion in SEQ ID NO 937
gtgaacaaagggtatgtagtgcaggtcatgggcccggtggtcgatgtccgctttccagaaggacaactgccggcgatcaacaacgccctccgcattgattacgagggcgatctgcccgtgcatctgacgctcgaggtggcgctgcacctcggagacaacgtggttcgaaccatcgcgatgtcgtcgacggacgggctcgtccgcggcgtcgaagtcgtcgatacagggcagcccatctcgatgcccgtaggaccgggcaccctggggcgcatcttcaacgtgctcggcgagacgattgacgagagggggcccgtcgatgccccggagcgctggccgatccaccgtcccgcgcccgcgtttggggatctgacgacgaagaccgagatcttcgaaaccggcatcaaggtcgtggatctgctcgctccgtacattaagggcggtaaggttggcctgttcggcggcgcgggcgtcggcaaaacggtgctcattcaggagctcattcacaacatcgcgaaggagcacggcggttattcggtgttcgccggcgtcggcgagcggacgcgcgagggtaacgacctctaccatgaaatgaaggagtcgggcgtcctcgacaagacgtgcatggtgttcggccagatgaacgagccgcccggtgcgcgcctccgcgtggcgctgtccggcctgacgctcgctgagtacttccgcgatgtggagcagcgcgacgtcctgttcttcatcgacaacatcttccgcttcacacaggcgggttccgaggtgtctgcgcttctcggccgcatgccgtcggccgtcggttaccagcccaccctggccacggaaatgggccaactgcaggaacgcattgcctcgacggtgcgagggtccatcacgtccatccaggcggtgtacgtgccggcggacgactacaccgatccggcgccggccaacacgttcacccacctcgatgccacgaccgtgttggagcgccggatcgccgacatgggcctgtatccggcggtcgatccgctcgcttcgacgtcgcgggcgctccagcctgacatcgtgggtgaggagcactatcaggtggcgcgtggcgtccaagcggtgctgcagcggtatcgcgagctgcaggacatcatcgccatcctcggcatggacgagctgacggatgaggaccgcctcatcgtgtcgcgcgcgcgcaaaatccagaacttcctgtcgcagccgttcttcgtcgctgaggtgttcaccgggacgccgggcaagtacgtgccggtgaaggataccgtgcgctcgttcaaggagatcctggagggcaagcacgacgacattccggagacgtacttccgctactgcggcgcgattgaagacgtgatcgagaaggcgcgcaaggacggctacgcctga

SEQ ID NO: 951 - DNA, 1404 bp, Artificial
  Substituion in SEQ ID NO 937
gtgaacaaagggtatgtagtgcaggtcatgggcccggtggtcgatgtccgctttccagaaggacaactgccggcgatcaacaacgccctccgcattgattacgagggcgatctgcccgtgcatctgacgctcgaggtggcgctgcacctcggagacaacgtggttcgaaccatcgcgatgtcgtcgacggacgggctcgtccgcggcgtcgaagtcgtcgatacagggcagcccatctcgatgcccgtaggaccgggcaccctggggcgcatcttcaacgtgctcggcgagacgattgacgagagggggcccgtcgatgccccggagcgctggccgatccaccgtcccgcgcccgcgtttggggatctgacgacgaagaccgagatcttcgaaaccggcatcaaggtcgtggatctgctcgctccgtacgtcaagggcggtaaggttggcctgttcggcggcgcgggcgtcggcaaaacggtgctcattcaggagctcattcacaacatcgcgaaggagcacggcggttattcggtgttcgccggcgtcggcgagcggacgcgcgagggtaacgacctctaccatgaaatgaaggagtcgggcgtcctcgacaagacgtgcatggtgttcggccagatgaacgagccgcccggtgcgcgcctccgcgtggcgctgtccggcctgacgctcgctgagtacttccgcgatgtggagcagcgcgacgtcctgttcttcatcgacaacatcttccgcttcacacaggcgggttccgaggtgtctgcgcttctcggccgcatgccgtcggccgtcggttaccagcccaccctggccacggaaatgggccaactgcaggaacgcattgcctcgacggtgcgagggtccatcacgtccatccaggcggtgtacgtgccggcggacgactacaccgatccggcgccggccaacacgttcacccacctcgatgccacgaccgtgttggagcgccggatcgccgacatgggcctgtatccggcggtcgatccgctcgcttcgacgtcgcgggcgctccagcctgacatcgtgggtgaggagcactatcaggtggcgcgtggcgtccaagcggtgctgcagcggtatcgcgagctgcaggacatcatcgccatcctcggcatggacgagctgacggatgaggaccgcctcatcgtgtcgcgcgcgcgcaaaatccagaacttcctgtcgcagccgttcttcgtcgctgaggtgttcaccgggacgccgggcaagtacgtgccggtgaaggataccgtgcgctcgttcaaggagatcctggagggcaagcacgacgacattccggagacgtacttccgctactgcggcgcgattgaagacgtgatcgagaaggcgcgcaaggaaggctacgcctga

SEQ ID NO: 952 - DNA, 1404 bp, Artificial
  Substituion in SEQ ID NO 937
gtgaacaaagggtatgtagtgcaggtcatgggcccggtggtcgatgtccgctttccagaaggacaactgccggcgatcaacaacgccctccgcattgattacgagggcgaactgcccgtgcatctgacgctcgaggtggcgctgcacctcggagacaacgtggttcgaaccatcgcgatgtcgtcgacggacgggctcgtccgcggcgtcgaagtcgtcgatacagggcagcccatctcgatgcccgtaggaccgggcaccctggggcgcatcttcaacgtgctcggcgagacgattgacgagagggggcccgtcgatgccccggagcgctggccgatccaccgtcccgcgcccgcgtttggggatctgacgacgaagaccgagatcttcgaaaccggcatcaaggtcgtggatctgctcgctccgtacgtcaagggcggtaaggttggcctgttcggcggcgcgggcgtcggcaaaacggtgctcattcaggagctcattcacaacatcgcgaaggagcacggcggttattcggtgttcgccggcgtcggcgagcggacgcgcgagggtaacgacctctaccatgaaatgaaggagtcgggcgtcctcgacaagacgtgcatggtgttcggccagatgaacgagccgcccggtgcgcgcctccgcgtggcgctgtccggcctgacgctcgctgagtacttccgcgatgtggagcagcgcgacgtcctgttcttcatcgacaacatcttccgcttcacacaggcgggttccgaggtgtctgcgcttctcggccgcatgccgtcggccgtcggttaccagcccaccctggccacggaaatgggccaactgcaggaacgcattgcctcgacggtgcgagggtccatcacgtccatccaggcggtgtacgtgccggcggacgactacaccgatccggcgccggccaacacgttcacccacctcgatgccacgaccgtgttggagcgccggatcgccgacatgggcctgtatccggcggtcgatccgctcgcttcgacgtcgcgggcgctccagcctgacatcgtgggtgaggagcactatcaggtggcgcgtggcgtccaagcggtgctgcagcggtatcgcgagctgcaggacatcatcgccatcctcggcatggacgagctgacggatgaggaccgcctcatcgtgtcgcgcgcgcgcaaaatccagaacttcctgtcgcagccgttcttcgtcgctgaggtgttcaccgggacgccgggcaagtacgtgccggtgaaggataccgtgcgctcgttcaaggagatcctggagggcaagcacgacgacattccggagacgtacttccgctactgcggcgcgattgaagacgtgatcgagaaggcgcgcaaggacggctacgcctga

SEQ ID NO: 953 - protein, 904 aa, Alicyclobacillus acidocaldarius
MGANLFQAKQTLTVGGKSYTYYRLDALQEQGVADISRLPISIKILLESVLRQYDGRVITEEHVRELANWNAANPAKSEVPFKPARILLQDFTGVPVVVDLAAMRTAMHKLGGNPKRINPLIPVDLVIDHSVQVDAFGSKEALEFNIAKEFERNEERYRFLRWAQTAFDNFRAVPPGMGIVHQVNLEYLARVVQERTVDGEQVVFPDSLVGTDSHTTMINGVGVLGWGVGGIEAEACMLGQPLYFVQPEVIGFKLTGKLPEGATATDLALTVVNMLRKKGVVGKFVEFYGAGLSNISVADRATIANMAPEYGATMGFFPIDQATLDYLRLTGRDESLIQLVEAYAKAQGMFRTDDMPDPVFTDTLELDLGSIQPTMAGPKRPQDKIFLSDMKNNFEAALEKPVSEGGFGLADQRDKTALVQYPDGHKDELHHGAVVIAAITSCTNTSNPSVMIGAGLLAKKAVEKGLKTPRYVKTSLAPGSRVVTDYLERSGLLEPLSKLGFDVVGYGCTTCIGNSGPLPEEVAKAIQENDLLVSAVLSGNRNFEGRIHSLVRANYLASPPLVVAYAIAGTVDIDLVNEPIGKDENGNDVFLRDIWPSNEEIQAVIRQIINPEMFKKEYESVFNRNERWNKLDVPKGELYEWDPNSTYIQEPPFFEGLSEEVPDIQEIQGARVLAYLGDSVTTDHISPAGSIAPSSPAGQYLQSKGVKPHEFNSYGSRRGNHEVMMRGTFANIRIRNKVAPGTEGGYTTYFPTGEVMPIYDAAMKYKADGTPLVVIAGKEYGTGSSRDWAAKGTYLLGVKAVIAESFERIHRSNLVGMGVLPLEFIDGQNAETLGLTGREVYTIKGLSNDLKPRQTVTVEVTREDGSSFTFQALVRLDSDIEVDYYRNGGILQTVLRNFMREQHA

SEQ ID NO: 954 - DNA, 2715 bp, Alicyclobacillus acidocaldarius
gtgggcgccaatctgtttcaagccaaacagaccctcaccgttggcgggaagtcctatacctactaccgcctggacgctcttcaggagcaaggcgtagccgacatctcccgcctccccatttccatcaaaattctgcttgaatccgtgcttcgccagtacgatggccgcgtcatcacggaggagcacgtgcgcgaactcgccaactggaacgcggcgaacccggcgaaatccgaggtcccttttaagcccgcgcgcatcctgctgcaggatttcacgggcgtgcctgtcgtggtggatctggccgccatgcgcacggcgatgcacaagctcggcggcaatccgaagcggatcaacccgctcatcccggtcgatctcgtcatcgaccactcggtgcaggtggacgcgttcggttccaaagaggcgctggagttcaacatcgcgaaggaattcgagcgcaacgaggagcgctaccgcttcctccgctgggcacaaacggcgttcgacaacttccgcgcggtgccacccggaatgggcatcgtccaccaggtcaacctggagtacctcgcgcgcgtggtccaggagcggaccgtcgacggcgagcaagtcgtcttcccggatagcctcgtcggcaccgactcgcacacgaccatgatcaacggcgtcggcgtcctcggctggggcgtgggcggcatcgaggccgaggcgtgcatgctcggtcagcccttgtacttcgtgcagcccgaggtcatcggcttcaagctgaccggcaaactgcccgagggcgcgaccgcgaccgatctcgccctgactgtcgtgaacatgctgcgcaagaagggcgtcgtcggcaagttcgtcgagttctacggcgccggcctctccaacatcagcgtcgctgaccgcgcgaccatcgccaacatggcgcccgagtacggtgcgacgatgggcttcttccccatcgaccaggcgacgctcgactatctccgcctgaccggccgcgacgaatcgctcatccagctcgtcgaggcgtacgcgaaggcacagggtatgttccgcacggacgacatgccggatcccgtcttcaccgacacgctggagctcgatctcggctccatccagccgacgatggcgggtccgaagcggccgcaggataagatcttcctctccgatatgaagaacaacttcgaggcggcgctcgagaagccggtgtcggagggcggtttcgggcttgcggaccagcgggataagacggcccttgtccaatatccggacgggcacaaggacgaactccaccacggcgcggtcgtgatcgccgccatcacgagctgcaccaacacctccaacccgtccgtgatgattggcgcggggctgttggcgaagaaggccgtggagaaggggctgaagacgccgcgctacgtgaagacgtcgctcgcgccgggatcgcgcgtcgtcacggattacctggagcgctcgggcctgctcgagccactctccaagctcggctttgacgtggtcggctacggctgtaccacgtgcatcggaaacagcggcccgctgccggaggaagtggccaaggcgattcaggagaacgacctcctggtctccgcggtgttgtcgggcaaccgcaacttcgaggggcgcatccactcgctcgttcgcgccaactatctcgcttcgccgccgctcgtcgtggcgtacgctatcgcgggcacggtggacatcgatctcgtcaacgagcccatcggcaaggacgagaacggcaacgacgtgttcctgagggacatctggccgtcgaacgaggagattcaggcggtcatccggcaaatcatcaatccggagatgttcaagaaggaatacgagagcgtgttcaaccggaacgagcggtggaacaagctggacgtcccgaagggcgagctgtacgaatgggatccgaattcgacgtacatccaggagccgccgttcttcgaggggctgtcggaagaggttccggacatccaggagatccaaggcgcgcgcgtgctcgcgtacctgggcgactcggtgacgacggaccacatctcgcccgcgggcagcatcgcgccgtcgagcccggctggccagtacctgcagtccaagggcgtgaagccgcatgagttcaactcgtacggttcgcgccgcggcaaccacgaggtcatgatgcgcggcacgttcgcgaacatccgcattcgcaacaaggtggcgcctggcacggagggcggttacacgacgtacttcccgacgggcgaagtgatgccgatttacgacgcggcgatgaagtacaaggcggatggcacgccgctcgtggtcatcgccggcaaggagtacggaacaggctcgtcccgcgactgggcggcgaagggcacctacttgctcggcgtgaaggccgtgatcgcggagagcttcgagcgcatccaccggagcaacctggtcggcatgggcgtgctgccgctcgagttcatcgacgggcaaaacgcggagacgcttggcctgaccggccgcgaggtgtacaccatcaaggggctgtcgaacgacctgaagccgcgccagacggtcacggtcgaagtcacgcgcgaagacggatcgtcgttcacgttccaagcgctcgtgcggctcgacagcgacatcgaggtggattactaccgcaacggcggtatcctgcagacagtgctccgcaacttcatgcgcgagcaacacgcgtaa

SEQ ID NO: 955 - protein, 893 aa, Bacillus selenitireducens MLS10
LYQAKKQFEVNGKTYHYYDLKAIEEAGIGNVSKLPYSIRVLLESVLRQHDGRVIKQEHVDNLAKFGSGELAAIDVPFKPARVILQDFTGVPAVVDLASLRKAMADFGGDPKEINPAIPVDLVVDHSLQVDKFGAADSLMFNMEREFERNLERYKFLNWAQKSLDNYRAVPPATGIVHQVNLEYLANVVQEEEQDGELVAFPDSLVGTDSHTTMINGLGVLGWGVGGIEAEAGMLKQPSYFPVPEVVGLKFTGKMPEGATATDLALKVTQILRQANVVGKFVEFFGPGLSDMTLADRATISNMAPEYGATCGFFPVDEETLNYMRFTGRSEELVKLVETYTKANDMYYTPDKEDPEFTEVIELDLGTIEPNLSGPKRPQDLIPLSQMKKEWRKALTAPVGNQGFGLEAAEADRSVDVKHPDGRTSQLKTGAVTIAAITSCTNTSNPHVMIGSGLLAKNAVDKGLEVPAYVKTSLAPGSKVVTGYLEDAGLMPYLDKLGFNLVGYGCTTCIGNSGPLPDEVEQAISENDLTVSSVLSGNRNFEGRIHPLVKANYLASPPLVVAYALAGTVDIDFETEPLGQDKEGNDVFFRDIWPSNEEIHKSMQEAVDPKLFKREYKRVFDDNERWNALETPDGDLYEFDEESTYIQNPPFFENLSPDPKDVEKLSGLRAVGKFGDSVTTDHISPAGAIAKNSPAGRYLMEKGLEPKDFNSYGSRRGNHEVMMRGTFANIRIKNQLAPGTEGGYTTHWPTGDVMAIYDACMQYKEEGTGLLVMAGKDYGMGSSRDWAAKGTNLLGIKTVIAESFERIHRSNLVLMGVLPLQFKSGENADTLGLTGEEHFDVHVDNDVQPRQEIKVTATDSDGKGTEFHVIARFDSEVEIDYYRHGGILQMVLRN

SEQ ID NO: 956 - protein, 895 aa, Herpetosiphon aurantiacus ATCC 23779
FGAKATLTVGDRSLVYYRLNKLEEDGIAAVSKLPFSIKVLLEAMLRNNDGFAVTKQDVENMARWNAANPEKIEVPFKPARVILQDFTGVPAVVDLAAMRAAMAQQGGDPQRINPLVPVDLVIDHSVQIDQFGSKMALFFNAEREFERNAERYEFLKWGQQAFDNFSVVPPETGIVHQVNLEYLAKVVQVFTEEGELVALPDSLVGTDSHTTMINGLGVVGWGVGGIEAEAVMLGQPIYMLLPEVIGFKVTGQLPEGATATDLALTVTELLRKKGVVGKFVEFYGPGVANMALSDRATIANMAPEYGATMGFFPVDQETIHFLRSTGRSDELADLVEAYSKAQGLFLDANSPEAEYTDTVHLDLSTIVPSVAGPKRPQDRVELQNTKASFQKSLTAPIAERGFALSTEKAENTATVQNNGHSATIGHGAVVIASITSCTNTSNPSVMLGAGLLAKKAVEKGLTVAPYVKTSLAPGSRVVSSYLEQAELIEPLEALGFHVVGYGCTTCIGNSGPLPEPVAAAVQEGELVAAAVLSGNRNFEGRINPLVKAAYLASPPLVVAYALAGTINLDLATEPLGNDKEGNPVYLRDIWPSQSEIQETVRKAIKPEMFTQQYGNVFAGSDAWKRVQAPTGNIYAWNNDSTYIQHPPFFQDLQPEPAPIGDITGARVLALLGDSVTTDHISPAGSIAKNSPAAKYLIDNGVDPQDFNSYGARRGNHEVMMRGTFANIRLKNLLLNGVEGGYTLYFPTGEQQSIYDASMAYQASGTPLVILAGKEYGTGSSRDWAAKGTYLLGVKVVIAESYERIHRSNLVGMGVLPLQYRAGESAASLGLKGDESFSVEGINDDLQARSELTVRAVRPDGSELSFQAVVRIDTPVEVEYYKNGGILHTVLRQLAK

SEQ ID NO: 957 - protein, 894 aa, Geobacillus thermodenitrificans NG80-2
DVFNARSSFEVNGKKYNYYRLQALEEAGIGRVSRLPYSIKVLLESVLRQVDGRVITKEHVENLAKWGTPEMKDIDVPFKPSRVILQDFTGVPAVVDLASMRKAMADLGGDPYEINPEIPVDLVIDHSVQVDRYGSDDALEYNMDLEFQRNAERYKFLKWAQKAFDNYRAVPPATGIVHQVNLEYLASVVHAVEGENGEYEAFPDTLVGTDSHTTMINGIGVLGWGVGGIEAEAGMLGQPSYFPVPEVVGVRLTGKLPDGSTATDLALKVTQVLRKKGVVGKFVEFFGPGVATLPLADRATIANMAPEYGATCGFFPVDAEALDYLRLTGRDEHHIQVVEAYCKANGLFYTPDAPEPTFTDVVEINLSEIETNLSGPKRPQDLIPLSKMKQSFREAVKAPQGNQGFGLTEADLEREITVTLNGEQVSMKTGAVVIAAITSCTNTSNPYVLVAAGLVAKKAVEKGLQVPKYVKTSLAPGSKVVTGYLRDSGLLPYLQQLGFNVVGYGCTTCIGNSGPLAPELEKALAESDLLVTSVLSGNRNFEGRIHPLVKGNYLASPPLVVAYALAGTVDIDLLNEPIGKDKDGNDVYFRDIWPSMEEVKEVVKRAVDPELFRKEYERVFDGNPRWNAIETTDEPLYQWDEQSTYIQNPPFFEGLSPDVRKVEPLTGLRVVGKFGDSVTTDHISPAGSIGKSTPAGQYLISKGVEPKDFNSYGSRRGNHEVMMRGTFANIRIRNQIAPGTEGGYTTYWPTGEVMSIYDACMKYKQDGTGLVVVAGKDYGMGSSRDWAAKGTFLLGIKTVIAESFERIHRSNLVLMGVLPLQFKEGENAETLGLTGKEVFEVQIDESVKPRDLVKVTATNPDTGEKKEFEVIVRFDSEVEIDYYRHGGILQMVLR

SEQ ID NO: 958 - protein, 894 aa, Geobacillus kaustophilus HTA426
DVFNTRSSFEVNGKKYNYYRLQALEEAGIGQVSRLPYSIKVLLESVLRQVDGRVITKEHVENLAKWGTPEMKDIDVPFKPSRVILQDFTGVPVVVDLASMRKAMADLGGDPYEINPEIPVDLVIDHSVQVDRYGSDDALEYNMDLEFKRNAERYKFLKWAQKAFDNYRAVPPATGIVHQVNLEYLASVVHAVEGENGEYEAFPDTLVGTDSHTTMINGLGVLGWGVGGIEAEAGMLGQPSYFPVPEVIGVRLTGKLPDGATATDLALKVTQVLRKKGVVGKFVEFFGPGVATLPLADRATIANMAPEYGATCGFFPVDAEALDYLRLTGRDEHHVQVVEAYCKANGLFYTPDAPEPVFTDVVEINLSEIETNLSGPKRPQDLIPLSKMKQSFRDAVKAPQGNQGFGLTEADLEREITVELNGEQVKLKTGAVVIAAITSCTNTSNPYVLVAAGLVAKKAVEKGLQVPKYVKTSLAPGSKVVTGYLRDSGLLPYLEQLGFNIVGYGCTTCIGNSGPLAPELEKALAESDLLVTSVLSGNRNFEGRIHPLVKGNYLASPPLVVAYALAGTVDIDLLSEPIGKGKDGSDVYFRDIWPSMEEVKDVVKRAVDPELFRKEYERVFDGNPRWNAIETTDEPLYQWDENSTYIQNPPFFEGLSPEVRKVEPLTGLRVVGKFGDSVTTDHISPAGSIGKNTPAGQYLISKGVDPKDFNSYGSRRGNHEVMMRGTFANIRIRNQIAPGTEGGYTTYWPTGEVMSMYDACMKYKQDGTGLVVIAGKDYGMGSSRDWAAKGTFLLGIKTVIAESFERIHRSNLVLMGVLPLQFKEGENAETLGLTGKEVFDIHIDENVKPRDLVKVTATNPDTGEKKEFEVIVRFDSEVEIDYYRHGGILQMVLR

SEQ ID NO: 959 - protein, 896 aa, Bacillus licheniformis ATCC 14580
FQSRKTFTVQGKTYSYYSLKALEDQGIGNVSKLPYSIKVLLESVLRQVDGRVITEEHVENLAKWGTAELKDIDVPFKPSRVILQDFTGVPAVVDLASLRKAMASVGGDPDKINPEIPVDLVIDHSVQVDKAGTEDALTVNMDLEFQRNAERYKFLSWAKKAFNNYQAVPPATGIVHQVNLEYLANVVHAVEEDGEIVTYPDTLVGTDSHTTMINGIGVLGWGVGGIEAEAGMLGQPSYFPVPEVIGAKLVGKLPNGTTATDLALKVTQVLREKGVVGKFVEFFGPGVAELPLADRATIANMAPEYGATCGFFPVDEEALEYMRLTGRDEEHINVVKEYCRQNGLFYTPDQEDPVFTDIVEIDLSKVEANLSGPKRPQDLIPLTDMKETFHKHLASPAGNQGFGLNASEADKEIKFKLENGEEAVMKTGAIAIAAITSCTNTSNPYVLIGAGLVAKKAVELGLKVPNYVKTSLAPGSKVVTGYLVNSGLLPYMRELGFNIVGYGCTTCIGNSGPLAPEIEKAVAENDLLITSVLSGNRNFEGRIHPLVKGNYLASPPLVVAYALAGTVDIDLKNEPIGVGKDGQNVYFNDIWPTMDEINSVVKQTVTPELFRKEYERVFDDNERWNAIETTDEALYKWDEESTYIQNPPFFENMSVEPGTVEPLKGLRIVGKFGDSVTTDHISPAGAIGKDTPAGKYLQEKGVSPRDFNSYGSRRGNHEVMMRGTFANIRIKNQIAPGTEGGYTTYWPTGEVMSIYDACMKYKEDGTGLVVIAGKDYGMGSSRDWAAKGTNLLGIKTVIAESFERIHRSNLVLMGVLPLQFKEGENAETLGLTGKETIEVDVSESVRPRDLVQVKAIAEDGTVKSFEAVVRFDSEVEIDYYRHGGILQMVLRNKMKQ

SEQ ID NO: 960 - protein, 904 aa, Artificial
  Substituion in SEQ ID NO 953
MGANLFQAKQTLTVGGKSYTYYRLDALQEQGVADISRLPISIKILLESVLRQYDGRVITEEHVRELANWNAANPAKSEVPFKPARILLQDFTGVPVVVDLAAMRTAMHKLGGNPKRINPLIPVDLVIDHSVQVDAFGSKEALEFNIAKEFERNEERYRFLRWAQTAFDNFRAVPPGMGIVHQVNLEYLARVVQERTVDGEQVVFPDSLVGTDSHTTMINGVGVLGWGVGGIEAEACMLGQPLYFVQPEVIGFKLTGKLPEGATATDLALTVVNMLRKKGVVGKFVEFYGAGLSNISVADRATIANMAPEYGATMGFFPIDQATLDYLRLTGRDESLIQLVEAYAKAQGMFRTDDMPDPVFTDTLELDLGSIQPTMAGPKRPQDKIFLSDMKNNFEAALEKPVSEGGFGLADQRDKTALVQYPDGHKDELHHGAVVIAAITSCTNTSNPSVMIGAGLLAKKAVEKGLKTPRYVKTSLAPGSRVVTDYLERSGLLEPLSKLGFDVVGYGCTTCIGNSGPLPEEVAKAIQENDLLVSAVLSGNRNFEGRIHSLVRANYLASPPLVVAYAIAGTVDIDLVNEPIGKDENGNDVFLRDIWPSNEEIQAVIRQIINPEMFKKEYESVFNRNERWNKLDVPKGELYDWDPNSTYIQEPPFFEGLSEEVPDIQEIQGARVLAYLGDSVTTDHISPAGSIAPSSPAGQYLQSKGVKPHEFNSYGSRRGNHEVMMRGTFANIRIRNKVAPGTEGGYTTYFPTGEVMPIYDAAMKYKADGTPLVVIAGKEYGTGSSRDWAAKGTYLLGVKAVIAESFERIHRSNLVGMGVLPLEFIDGQNAETLGLTGREVYTIKGLSNDLKPRQTVTVEVTREDGSSFTFQALVRLDSDIEVDYYRNGGILQTVLRNFMREQHA

SEQ ID NO: 961 - protein, 904 aa, Artificial
  Substituion in SEQ ID NO 953
MGANLFQAKQTLTVGGKSYTYYRLDALQEQGVADISRLPISIKILLESVLRQYDGRVITEEHVRELANWNAANPAKSEVPFKPARILLQDFTGVPVVVDLAAMRTAMHKLGGNPKRINPLIPVDLVIDHSVQVDAFGSKEALEFNIAKEFERNEERYRFLRWAQTAFDNFRAVPPGMGIVHQVNLEYLARVVQERTVDGEQVVFPDSLVGTDSHTTMINGVGVLGWGVGGIEAEACMLGQPLYFVQPEVIGFKLTGKLPEGATATDLALTVVNMLRKKGVVGKFVEFYGAGLSNISVADRATIANMAPEYGATMGFFPIDQATLDYLRLTGRDESLIQLVEAYAKAQGMFRTDDMPDPVFTDTLELDLGSIQPTMAGPKRPQDKIFLSDMKNNFEAALEKPVSEGGFGLADQRDKTALVQYPDGHKDELHHGAVVIAAITSCTNTSNPSVMIGAGLLAKKAVEKGLKTPRYVKTSLAPGSRVVTDYLERSGLLEPLSKLGFDVVGYGCTTCIGNSGPLPEEVAKAIQENDLLVSAVLSGNRNFEGRIHSLVRANYLASPPLVVAYAIAGTVDIDLINEPIGKDENGNDVFLRDIWPSNEEIQAVIRQIINPEMFKKEYESVFNRNERWNKLDVPKGELYEWDPNSTYIQEPPFFEGLSEEVPDIQEIQGARVLAYLGDSVTTDHISPAGSIAPSSPAGQYLQSKGVKPHEFNSYGSRRGNHEVMMRGTFANIRIRNKVAPGTEGGYTTYFPTGEVMPIYDAAMKYKADGTPLVVIAGKEYGTGSSRDWAAKGTYLLGVKAVIAESFERIHRSNLVGMGVLPLEFIDGQNAETLGLTGREVYTIKGLSNDLKPRQTVTVEVTREDGSSFTFQALVRLDSDIEVDYYRNGGILQTVLRNFMREQHA

SEQ ID NO: 962 - protein, 904 aa, Artificial
  Substituion in SEQ ID NO 953
MGANLFQAKQTLTVGGKSYTYYRLDALQEQGVADISRLPISIKILLESVLRQYDGRVITEEHVRELANWNAANPAKSEVPFKPARILLQDFTGVPVVVDLAAMRTAMHKLGGNPKRINPLIPVDLVIDHSVQVDAFGSKEALEFNIAKEFERNEERYRFLRWAQTAFDNFRAVPPGMGIVHQVNLEYLARVVQERTVDGEQVVFPDSLVGTDSHTTMINGVGVLGWGVGGIEAEACMLGQPLYFVQPEVIGFKLTGKLPEGATATDLALTVVNMLRKKGVVGKFVEFYGAGLSNISVADRATIANMAPEYGATMGFFPIDQATLDYLRLTGRDESLIQLVEAYAKAQGMFRTDDMPDPVFTDTLELDLGSIQPTMAGPKRPQDKIFLSDMKNNFEAALEKPVSEGGFGLADQRDKTALVQYPDGHKDELHHGAVVIAAITSCTNTSNPSVMIGAGLLAKKAVEKGLKTPRYVKTSLAPGSRVVTDYLEKSGLLEPLSKLGFDVVGYGCTTCIGNSGPLPEEVAKAIQENDLLVSAVLSGNRNFEGRIHSLVRANYLASPPLVVAYAIAGTVDIDLVNEPIGKDENGNDVFLRDIWPSNEEIQAVIRQIINPEMFKKEYESVFNRNERWNKLDVPKGELYEWDPNSTYIQEPPFFEGLSEEVPDIQEIQGARVLAYLGDSVTTDHISPAGSIAPSSPAGQYLQSKGVKPHEFNSYGSRRGNHEVMMRGTFANIRIRNKVAPGTEGGYTTYFPTGEVMPIYDAAMKYKADGTPLVVIAGKEYGTGSSRDWAAKGTYLLGVKAVIAESFERIHRSNLVGMGVLPLEFIDGQNAETLGLTGREVYTIKGLSNDLKPRQTVTVEVTREDGSSFTFQALVRLDSDIEVDYYRNGGILQTVLRNFMREQHA

SEQ ID NO: 963 - protein, 904 aa, Artificial
  Substituion in SEQ ID NO 953
MGANLFQAKQTLTVGGKSYTYYRLDALQEQGVADISRLPISIKILLESVLRQYDGRVITEEHVRELANWNAANPAKSEVPFKPARILLQDFTGVPVVVDLAAMRTAMHKLGGNPKRINPLIPVDLVIDHSVQVDAFGSKEALEFNIAKEFERNEERYRFLRWAQTAFDNFRAVPPGMGIVHQVNLEYLARVVQERTVDGEQVVFPDSLVGTDSHTTMINGVGVLGWGVGGIEAEACMLGQPLYFVQPEVIGFKLTGKLPEGATATDLALTVVNMLRKKGVVGKFVEFYGAGLSNISVADRATIANMAPEYGATMGFFPIDQATLDYLRLTGRDESLIQLVEAYAKAQGMFRTDDMPDPVFTDTLELDLGSIQPTMAGPKRPQDKIFLSDMKNNFEAALEKPVSEGGFGLADQRDKTALVQYPDGHKDELHHGAVVIAAITSCTNTSNPSVMIGAGLLAKKAVEKGLKTPRYVKTSLAPGSRVVTDYLERSGLLEPLSKLGFDVVGYGCTTCIGNSGPLPEEVAKAIQENDLLVSAVLSGNRNFEGRIHSLVRANYLASPPLVVAYAIAGTVDIDLVNEPIGKDENGNDVFLRDIWPSNEEIQAVIRQIIQPEMFKKEYESVFNRNERWNKLDVPKGELYEWDPNSTYIQEPPFFEGLSEEVPDIQEIQGARVLAYLGDSVTTDHISPAGSIAPSSPAGQYLQSKGVKPHEFNSYGSRRGNHEVMMRGTFANIRIRNKVAPGTEGGYTTYFPTGEVMPIYDAAMKYKADGTPLVVIAGKEYGTGSSRDWAAKGTYLLGVKAVIAESFERIHRSNLVGMGVLPLEFIDGQNAETLGLTGREVYTIKGLSNDLKPRQTVTVEVTREDGSSFTFQALVRLDSDIEVDYYRNGGILQTVLRNFMREQHA

SEQ ID NO: 964 - protein, 904 aa, Artificial
  Substituion in SEQ ID NO 953
MGANLFQAKQTLTVGGKSYTYYRLDALQEQGVADISRLPISIKILLESVLRQYDGRVITEEHVRELANWNAANPAKSEVPFKPARILLQDFTGVPVVVDLAAMRTAMHKLGGNPKRINPLIPVDLVIDHSVQVDAFGSKEALEFNIAKEFERNEERYRFLRWAQTAFDNFRAVPPGMGIVHQVNLEYLARVVQERTVDGEQVVFPDSLVGTDSHTTMINGVGVLGWGVGGIEAEACMLGQPLYFIQPEVIGFKLTGKLPEGATATDLALTVVNMLRKKGVVGKFVEFYGAGLSNISVADRATIANMAPEYGATMGFFPIDQATLDYLRLTGRDESLIQLVEAYAKAQGMFRTDDMPDPVFTDTLELDLGSIQPTMAGPKRPQDKIFLSDMKNNFEAALEKPVSEGGFGLADQRDKTALVQYPDGHKDELHHGAVVIAAITSCTNTSNPSVMIGAGLLAKKAVEKGLKTPRYVKTSLAPGSRVVTDYLERSGLLEPLSKLGFDVVGYGCTTCIGNSGPLPEEVAKAIQENDLLVSAVLSGNRNFEGRIHSLVRANYLASPPLVVAYAIAGTVDIDLVNEPIGKDENGNDVFLRDIWPSNEEIQAVIRQIINPEMFKKEYESVFNRNERWNKLDVPKGELYEWDPNSTYIQEPPFFEGLSEEVPDIQEIQGARVLAYLGDSVTTDHISPAGSIAPSSPAGQYLQSKGVKPHEFNSYGSRRGNHEVMMRGTFANIRIRNKVAPGTEGGYTTYFPTGEVMPIYDAAMKYKADGTPLVVIAGKEYGTGSSRDWAAKGTYLLGVKAVIAESFERIHRSNLVGMGVLPLEFIDGQNAETLGLTGREVYTIKGLSNDLKPRQTVTVEVTREDGSSFTFQALVRLDSDIEVDYYRNGGILQTVLRNFMREQHA

SEQ ID NO: 965 - DNA, 2715 bp, Artificial
  Substituion in SEQ ID NO 954
gtgggcgccaatctgtttcaagccaaacagaccctcaccgttggcgggaagtcctatacctactaccgcctggacgctcttcaggagcaaggcgtagccgacatctcccgcctccccatttccatcaaaattctgcttgaatccgtgcttcgccagtacgatggccgcgtcatcacggaggagcacgtgcgcgaactcgccaactggaacgcggcgaacccggcgaaatccgaggtcccttttaagcccgcgcgcatcctgctgcaggatttcacgggcgtgcctgtcgtggtggatctggccgccatgcgcacggcgatgcacaagctcggcggcaatccgaagcggatcaacccgctcatcccggtcgatctcgtcatcgaccactcggtgcaggtggacgcgttcggttccaaagaggcgctggagttcaacatcgcgaaggaattcgagcgcaacgaggagcgctaccgcttcctccgctgggcacaaacggcgttcgacaacttccgcgcggtgccacccggaatgggcatcgtccaccaggtcaacctggagtacctcgcgcgcgtggtccaggagcggaccgtcgacggcgagcaagtcgtcttcccggatagcctcgtcggcaccgactcgcacacgaccatgatcaacggcgtcggcgtcctcggctggggcgtgggcggcatcgaggccgaggcgtgcatgctcggtcagcccttgtacttcgtgcagcccgaggtcatcggcttcaagctgaccggcaaactgcccgagggcgcgaccgcgaccgatctcgccctgactgtcgtgaacatgctgcgcaagaagggcgtcgtcggcaagttcgtcgagttctacggcgccggcctctccaacatcagcgtcgctgaccgcgcgaccatcgccaacatggcgcccgagtacggtgcgacgatgggcttcttccccatcgaccaggcgacgctcgactatctccgcctgaccggccgcgacgaatcgctcatccagctcgtcgaggcgtacgcgaaggcacagggtatgttccgcacggacgacatgccggatcccgtcttcaccgacacgctggagctcgatctcggctccatccagccgacgatggcgggtccgaagcggccgcaggataagatcttcctctccgatatgaagaacaacttcgaggcggcgctcgagaagccggtgtcggagggcggtttcgggcttgcggaccagcgggataagacggcccttgtccaatatccggacgggcacaaggacgaactccaccacggcgcggtcgtgatcgccgccatcacgagctgcaccaacacctccaacccgtccgtgatgattggcgcggggctgttggcgaagaaggccgtggagaaggggctgaagacgccgcgctacgtgaagacgtcgctcgcgccgggatcgcgcgtcgtcacggattacctggagcgctcgggcctgctcgagccactctccaagctcggctttgacgtggtcggctacggctgtaccacgtgcatcggaaacagcggcccgctgccggaggaagtggccaaggcgattcaggagaacgacctcctggtctccgcggtgttgtcgggcaaccgcaacttcgaggggcgcatccactcgctcgttcgcgccaactatctcgcttcgccgccgctcgtcgtggcgtacgctatcgcgggcacggtggacatcgatctcgtcaacgagcccatcggcaaggacgagaacggcaacgacgtgttcctgagggacatctggccgtcgaacgaggagattcaggcggtcatccggcaaatcatcaatccggagatgttcaagaaggaatacgagagcgtgttcaaccggaacgagcggtggaacaagctggacgtcccgaagggcgagctgtacgattgggatccgaattcgacgtacatccaggagccgccgttcttcgaggggctgtcggaagaggttccggacatccaggagatccaaggcgcgcgcgtgctcgcgtacctgggcgactcggtgacgacggaccacatctcgcccgcgggcagcatcgcgccgtcgagcccggctggccagtacctgcagtccaagggcgtgaagccgcatgagttcaactcgtacggttcgcgccgcggcaaccacgaggtcatgatgcgcggcacgttcgcgaacatccgcattcgcaacaaggtggcgcctggcacggagggcggttacacgacgtacttcccgacgggcgaagtgatgccgatttacgacgcggcgatgaagtacaaggcggatggcacgccgctcgtggtcatcgccggcaaggagtacggaacaggctcgtcccgcgactgggcggcgaagggcacctacttgctcggcgtgaaggccgtgatcgcggagagcttcgagcgcatccaccggagcaacctggtcggcatgggcgtgctgccgctcgagttcatcgacgggcaaaacgcggagacgcttggcctgaccggccgcgaggtgtacaccatcaaggggctgtcgaacgacctgaagccgcgccagacggtcacggtcgaagtcacgcgcgaagacggatcgtcgttcacgttccaagcgctcgtgcggctcgacagcgacatcgaggtggattactaccgcaacggcggtatcctgcagacagtgctccgcaacttcatgcgcgagcaacacgcgtaa

SEQ ID NO: 966 - DNA, 2715 bp, Artificial
  Substituion in SEQ ID NO 954
gtgggcgccaatctgtttcaagccaaacagaccctcaccgttggcgggaagtcctatacctactaccgcctggacgctcttcaggagcaaggcgtagccgacatctcccgcctccccatttccatcaaaattctgcttgaatccgtgcttcgccagtacgatggccgcgtcatcacggaggagcacgtgcgcgaactcgccaactggaacgcggcgaacccggcgaaatccgaggtcccttttaagcccgcgcgcatcctgctgcaggatttcacgggcgtgcctgtcgtggtggatctggccgccatgcgcacggcgatgcacaagctcggcggcaatccgaagcggatcaacccgctcatcccggtcgatctcgtcatcgaccactcggtgcaggtggacgcgttcggttccaaagaggcgctggagttcaacatcgcgaaggaattcgagcgcaacgaggagcgctaccgcttcctccgctgggcacaaacggcgttcgacaacttccgcgcggtgccacccggaatgggcatcgtccaccaggtcaacctggagtacctcgcgcgcgtggtccaggagcggaccgtcgacggcgagcaagtcgtcttcccggatagcctcgtcggcaccgactcgcacacgaccatgatcaacggcgtcggcgtcctcggctggggcgtgggcggcatcgaggccgaggcgtgcatgctcggtcagcccttgtacttcgtgcagcccgaggtcatcggcttcaagctgaccggcaaactgcccgagggcgcgaccgcgaccgatctcgccctgactgtcgtgaacatgctgcgcaagaagggcgtcgtcggcaagttcgtcgagttctacggcgccggcctctccaacatcagcgtcgctgaccgcgcgaccatcgccaacatggcgcccgagtacggtgcgacgatgggcttcttccccatcgaccaggcgacgctcgactatctccgcctgaccggccgcgacgaatcgctcatccagctcgtcgaggcgtacgcgaaggcacagggtatgttccgcacggacgacatgccggatcccgtcttcaccgacacgctggagctcgatctcggctccatccagccgacgatggcgggtccgaagcggccgcaggataagatcttcctctccgatatgaagaacaacttcgaggcggcgctcgagaagccggtgtcggagggcggtttcgggcttgcggaccagcgggataagacggcccttgtccaatatccggacgggcacaaggacgaactccaccacggcgcggtcgtgatcgccgccatcacgagctgcaccaacacctccaacccgtccgtgatgattggcgcggggctgttggcgaagaaggccgtggagaaggggctgaagacgccgcgctacgtgaagacgtcgctcgcgccgggatcgcgcgtcgtcacggattacctggagcgctcgggcctgctcgagccactctccaagctcggctttgacgtggtcggctacggctgtaccacgtgcatcggaaacagcggcccgctgccggaggaagtggccaaggcgattcaggagaacgacctcctggtctccgcggtgttgtcgggcaaccgcaacttcgaggggcgcatccactcgctcgttcgcgccaactatctcgcttcgccgccgctcgtcgtggcgtacgctatcgcgggcacggtggacatcgatctcattaacgagcccatcggcaaggacgagaacggcaacgacgtgttcctgagggacatctggccgtcgaacgaggagattcaggcggtcatccggcaaatcatcaatccggagatgttcaagaaggaatacgagagcgtgttcaaccggaacgagcggtggaacaagctggacgtcccgaagggcgagctgtacgaatgggatccgaattcgacgtacatccaggagccgccgttcttcgaggggctgtcggaagaggttccggacatccaggagatccaaggcgcgcgcgtgctcgcgtacctgggcgactcggtgacgacggaccacatctcgcccgcgggcagcatcgcgccgtcgagcccggctggccagtacctgcagtccaagggcgtgaagccgcatgagttcaactcgtacggttcgcgccgcggcaaccacgaggtcatgatgcgcggcacgttcgcgaacatccgcattcgcaacaaggtggcgcctggcacggagggcggttacacgacgtacttcccgacgggcgaagtgatgccgatttacgacgcggcgatgaagtacaaggcggatggcacgccgctcgtggtcatcgccggcaaggagtacggaacaggctcgtcccgcgactgggcggcgaagggcacctacttgctcggcgtgaaggccgtgatcgcggagagcttcgagcgcatccaccggagcaacctggtcggcatgggcgtgctgccgctcgagttcatcgacgggcaaaacgcggagacgcttggcctgaccggccgcgaggtgtacaccatcaaggggctgtcgaacgacctgaagccgcgccagacggtcacggtcgaagtcacgcgcgaagacggatcgtcgttcacgttccaagcgctcgtgcggctcgacagcgacatcgaggtggattactaccgcaacggcggtatcctgcagacagtgctccgcaacttcatgcgcgagcaacacgcgtaa

SEQ ID NO: 967 - DNA, 2715 bp, Artificial
  Substituion in SEQ ID NO 954
gtgggcgccaatctgtttcaagccaaacagaccctcaccgttggcgggaagtcctatacctactaccgcctggacgctcttcaggagcaaggcgtagccgacatctcccgcctccccatttccatcaaaattctgcttgaatccgtgcttcgccagtacgatggccgcgtcatcacggaggagcacgtgcgcgaactcgccaactggaacgcggcgaacccggcgaaatccgaggtcccttttaagcccgcgcgcatcctgctgcaggatttcacgggcgtgcctgtcgtggtggatctggccgccatgcgcacggcgatgcacaagctcggcggcaatccgaagcggatcaacccgctcatcccggtcgatctcgtcatcgaccactcggtgcaggtggacgcgttcggttccaaagaggcgctggagttcaacatcgcgaaggaattcgagcgcaacgaggagcgctaccgcttcctccgctgggcacaaacggcgttcgacaacttccgcgcggtgccacccggaatgggcatcgtccaccaggtcaacctggagtacctcgcgcgcgtggtccaggagcggaccgtcgacggcgagcaagtcgtcttcccggatagcctcgtcggcaccgactcgcacacgaccatgatcaacggcgtcggcgtcctcggctggggcgtgggcggcatcgaggccgaggcgtgcatgctcggtcagcccttgtacttcgtgcagcccgaggtcatcggcttcaagctgaccggcaaactgcccgagggcgcgaccgcgaccgatctcgccctgactgtcgtgaacatgctgcgcaagaagggcgtcgtcggcaagttcgtcgagttctacggcgccggcctctccaacatcagcgtcgctgaccgcgcgaccatcgccaacatggcgcccgagtacggtgcgacgatgggcttcttccccatcgaccaggcgacgctcgactatctccgcctgaccggccgcgacgaatcgctcatccagctcgtcgaggcgtacgcgaaggcacagggtatgttccgcacggacgacatgccggatcccgtcttcaccgacacgctggagctcgatctcggctccatccagccgacgatggcgggtccgaagcggccgcaggataagatcttcctctccgatatgaagaacaacttcgaggcggcgctcgagaagccggtgtcggagggcggtttcgggcttgcggaccagcgggataagacggcccttgtccaatatccggacgggcacaaggacgaactccaccacggcgcggtcgtgatcgccgccatcacgagctgcaccaacacctccaacccgtccgtgatgattggcgcggggctgttggcgaagaaggccgtggagaaggggctgaagacgccgcgctacgtgaagacgtcgctcgcgccgggatcgcgcgtcgtcacggattacctggagaaatcgggcctgctcgagccactctccaagctcggctttgacgtggtcggctacggctgtaccacgtgcatcggaaacagcggcccgctgccggaggaagtggccaaggcgattcaggagaacgacctcctggtctccgcggtgttgtcgggcaaccgcaacttcgaggggcgcatccactcgctcgttcgcgccaactatctcgcttcgccgccgctcgtcgtggcgtacgctatcgcgggcacggtggacatcgatctcgtcaacgagcccatcggcaaggacgagaacggcaacgacgtgttcctgagggacatctggccgtcgaacgaggagattcaggcggtcatccggcaaatcatcaatccggagatgttcaagaaggaatacgagagcgtgttcaaccggaacgagcggtggaacaagctggacgtcccgaagggcgagctgtacgaatgggatccgaattcgacgtacatccaggagccgccgttcttcgaggggctgtcggaagaggttccggacatccaggagatccaaggcgcgcgcgtgctcgcgtacctgggcgactcggtgacgacggaccacatctcgcccgcgggcagcatcgcgccgtcgagcccggctggccagtacctgcagtccaagggcgtgaagccgcatgagttcaactcgtacggttcgcgccgcggcaaccacgaggtcatgatgcgcggcacgttcgcgaacatccgcattcgcaacaaggtggcgcctggcacggagggcggttacacgacgtacttcccgacgggcgaagtgatgccgatttacgacgcggcgatgaagtacaaggcggatggcacgccgctcgtggtcatcgccggcaaggagtacggaacaggctcgtcccgcgactgggcggcgaagggcacctacttgctcggcgtgaaggccgtgatcgcggagagcttcgagcgcatccaccggagcaacctggtcggcatgggcgtgctgccgctcgagttcatcgacgggcaaaacgcggagacgcttggcctgaccggccgcgaggtgtacaccatcaaggggctgtcgaacgacctgaagccgcgccagacggtcacggtcgaagtcacgcgcgaagacggatcgtcgttcacgttccaagcgctcgtgcggctcgacagcgacatcgaggtggattactaccgcaacggcggtatcctgcagacagtgctccgcaacttcatgcgcgagcaacacgcgtaa

SEQ ID NO: 968 - DNA, 2715 bp, Artificial
  Substituion in SEQ ID NO 954
gtgggcgccaatctgtttcaagccaaacagaccctcaccgttggcgggaagtcctatacctactaccgcctggacgctcttcaggagcaaggcgtagccgacatctcccgcctccccatttccatcaaaattctgcttgaatccgtgcttcgccagtacgatggccgcgtcatcacggaggagcacgtgcgcgaactcgccaactggaacgcggcgaacccggcgaaatccgaggtcccttttaagcccgcgcgcatcctgctgcaggatttcacgggcgtgcctgtcgtggtggatctggccgccatgcgcacggcgatgcacaagctcggcggcaatccgaagcggatcaacccgctcatcccggtcgatctcgtcatcgaccactcggtgcaggtggacgcgttcggttccaaagaggcgctggagttcaacatcgcgaaggaattcgagcgcaacgaggagcgctaccgcttcctccgctgggcacaaacggcgttcgacaacttccgcgcggtgccacccggaatgggcatcgtccaccaggtcaacctggagtacctcgcgcgcgtggtccaggagcggaccgtcgacggcgagcaagtcgtcttcccggatagcctcgtcggcaccgactcgcacacgaccatgatcaacggcgtcggcgtcctcggctggggcgtgggcggcatcgaggccgaggcgtgcatgctcggtcagcccttgtacttcgtgcagcccgaggtcatcggcttcaagctgaccggcaaactgcccgagggcgcgaccgcgaccgatctcgccctgactgtcgtgaacatgctgcgcaagaagggcgtcgtcggcaagttcgtcgagttctacggcgccggcctctccaacatcagcgtcgctgaccgcgcgaccatcgccaacatggcgcccgagtacggtgcgacgatgggcttcttccccatcgaccaggcgacgctcgactatctccgcctgaccggccgcgacgaatcgctcatccagctcgtcgaggcgtacgcgaaggcacagggtatgttccgcacggacgacatgccggatcccgtcttcaccgacacgctggagctcgatctcggctccatccagccgacgatggcgggtccgaagcggccgcaggataagatcttcctctccgatatgaagaacaacttcgaggcggcgctcgagaagccggtgtcggagggcggtttcgggcttgcggaccagcgggataagacggcccttgtccaatatccggacgggcacaaggacgaactccaccacggcgcggtcgtgatcgccgccatcacgagctgcaccaacacctccaacccgtccgtgatgattggcgcggggctgttggcgaagaaggccgtggagaaggggctgaagacgccgcgctacgtgaagacgtcgctcgcgccgggatcgcgcgtcgtcacggattacctggagcgctcgggcctgctcgagccactctccaagctcggctttgacgtggtcggctacggctgtaccacgtgcatcggaaacagcggcccgctgccggaggaagtggccaaggcgattcaggagaacgacctcctggtctccgcggtgttgtcgggcaaccgcaacttcgaggggcgcatccactcgctcgttcgcgccaactatctcgcttcgccgccgctcgtcgtggcgtacgctatcgcgggcacggtggacatcgatctcgtcaacgagcccatcggcaaggacgagaacggcaacgacgtgttcctgagggacatctggccgtcgaacgaggagattcaggcggtcatccggcaaatcatccaaccggagatgttcaagaaggaatacgagagcgtgttcaaccggaacgagcggtggaacaagctggacgtcccgaagggcgagctgtacgaatgggatccgaattcgacgtacatccaggagccgccgttcttcgaggggctgtcggaagaggttccggacatccaggagatccaaggcgcgcgcgtgctcgcgtacctgggcgactcggtgacgacggaccacatctcgcccgcgggcagcatcgcgccgtcgagcccggctggccagtacctgcagtccaagggcgtgaagccgcatgagttcaactcgtacggttcgcgccgcggcaaccacgaggtcatgatgcgcggcacgttcgcgaacatccgcattcgcaacaaggtggcgcctggcacggagggcggttacacgacgtacttcccgacgggcgaagtgatgccgatttacgacgcggcgatgaagtacaaggcggatggcacgccgctcgtggtcatcgccggcaaggagtacggaacaggctcgtcccgcgactgggcggcgaagggcacctacttgctcggcgtgaaggccgtgatcgcggagagcttcgagcgcatccaccggagcaacctggtcggcatgggcgtgctgccgctcgagttcatcgacgggcaaaacgcggagacgcttggcctgaccggccgcgaggtgtacaccatcaaggggctgtcgaacgacctgaagccgcgccagacggtcacggtcgaagtcacgcgcgaagacggatcgtcgttcacgttccaagcgctcgtgcggctcgacagcgacatcgaggtggattactaccgcaacggcggtatcctgcagacagtgctccgcaacttcatgcgcgagcaacacgcgtaa

SEQ ID NO: 969 - DNA, 2715 bp, Artificial
  Substituion in SEQ ID NO 954
gtgggcgccaatctgtttcaagccaaacagaccctcaccgttggcgggaagtcctatacctactaccgcctggacgctcttcaggagcaaggcgtagccgacatctcccgcctccccatttccatcaaaattctgcttgaatccgtgcttcgccagtacgatggccgcgtcatcacggaggagcacgtgcgcgaactcgccaactggaacgcggcgaacccggcgaaatccgaggtcccttttaagcccgcgcgcatcctgctgcaggatttcacgggcgtgcctgtcgtggtggatctggccgccatgcgcacggcgatgcacaagctcggcggcaatccgaagcggatcaacccgctcatcccggtcgatctcgtcatcgaccactcggtgcaggtggacgcgttcggttccaaagaggcgctggagttcaacatcgcgaaggaattcgagcgcaacgaggagcgctaccgcttcctccgctgggcacaaacggcgttcgacaacttccgcgcggtgccacccggaatgggcatcgtccaccaggtcaacctggagtacctcgcgcgcgtggtccaggagcggaccgtcgacggcgagcaagtcgtcttcccggatagcctcgtcggcaccgactcgcacacgaccatgatcaacggcgtcggcgtcctcggctggggcgtgggcggcatcgaggccgaggcgtgcatgctcggtcagcccttgtacttcattcagcccgaggtcatcggcttcaagctgaccggcaaactgcccgagggcgcgaccgcgaccgatctcgccctgactgtcgtgaacatgctgcgcaagaagggcgtcgtcggcaagttcgtcgagttctacggcgccggcctctccaacatcagcgtcgctgaccgcgcgaccatcgccaacatggcgcccgagtacggtgcgacgatgggcttcttccccatcgaccaggcgacgctcgactatctccgcctgaccggccgcgacgaatcgctcatccagctcgtcgaggcgtacgcgaaggcacagggtatgttccgcacggacgacatgccggatcccgtcttcaccgacacgctggagctcgatctcggctccatccagccgacgatggcgggtccgaagcggccgcaggataagatcttcctctccgatatgaagaacaacttcgaggcggcgctcgagaagccggtgtcggagggcggtttcgggcttgcggaccagcgggataagacggcccttgtccaatatccggacgggcacaaggacgaactccaccacggcgcggtcgtgatcgccgccatcacgagctgcaccaacacctccaacccgtccgtgatgattggcgcggggctgttggcgaagaaggccgtggagaaggggctgaagacgccgcgctacgtgaagacgtcgctcgcgccgggatcgcgcgtcgtcacggattacctggagcgctcgggcctgctcgagccactctccaagctcggctttgacgtggtcggctacggctgtaccacgtgcatcggaaacagcggcccgctgccggaggaagtggccaaggcgattcaggagaacgacctcctggtctccgcggtgttgtcgggcaaccgcaacttcgaggggcgcatccactcgctcgttcgcgccaactatctcgcttcgccgccgctcgtcgtggcgtacgctatcgcgggcacggtggacatcgatctcgtcaacgagcccatcggcaaggacgagaacggcaacgacgtgttcctgagggacatctggccgtcgaacgaggagattcaggcggtcatccggcaaatcatcaatccggagatgttcaagaaggaatacgagagcgtgttcaaccggaacgagcggtggaacaagctggacgtcccgaagggcgagctgtacgaatgggatccgaattcgacgtacatccaggagccgccgttcttcgaggggctgtcggaagaggttccggacatccaggagatccaaggcgcgcgcgtgctcgcgtacctgggcgactcggtgacgacggaccacatctcgcccgcgggcagcatcgcgccgtcgagcccggctggccagtacctgcagtccaagggcgtgaagccgcatgagttcaactcgtacggttcgcgccgcggcaaccacgaggtcatgatgcgcggcacgttcgcgaacatccgcattcgcaacaaggtggcgcctggcacggagggcggttacacgacgtacttcccgacgggcgaagtgatgccgatttacgacgcggcgatgaagtacaaggcggatggcacgccgctcgtggtcatcgccggcaaggagtacggaacaggctcgtcccgcgactgggcggcgaagggcacctacttgctcggcgtgaaggccgtgatcgcggagagcttcgagcgcatccaccggagcaacctggtcggcatgggcgtgctgccgctcgagttcatcgacgggcaaaacgcggagacgcttggcctgaccggccgcgaggtgtacaccatcaaggggctgtcgaacgacctgaagccgcgccagacggtcacggtcgaagtcacgcgcgaagacggatcgtcgttcacgttccaagcgctcgtgcggctcgacagcgacatcgaggtggattactaccgcaacggcggtatcctgcagacagtgctccgcaacttcatgcgcgagcaacacgcgtaa

SEQ ID NO: 970 - protein, 351 aa, Alicyclobacillus acidocaldarius
MKAARLHAFHTPFAIETVPDPEPGPEDAIVRVRAAGVCRSDLHIWQGELAWVGIRPQLPITLGHEFGGEVVAVGRNVRRFVAGDRVTVPFHNGCGRCPQCQSGRSNLCDEFGFYGATYDGCFAEYVRVPNADFNLIHLPDEVDFVTAAAMGCRYMTGFHAVMRGRVQPGEWVAVHGAGGVGLSAIQAAHAIGAQVIAVDIDDDKLEKARTEGAAVTINSRREERVFKAIKQVTRGGAHVSIDALGLAETVFNSVRCLRKGGRHVQVGLTSSSEQGMVALPVDIMTTGEIEFIGSFGNPHVAFDGLLRLVAAGRLRPKALVEREVSLAELNDVFHRMLRFETKGFNVITAFA

SEQ ID NO: 971 - DNA, 1056 bp, Alicyclobacillus acidocaldarius
gtgaaagctgcgcgcctgcacgcattccacacgccctttgccatcgagaccgtcccagatcccgaacctggcccggaggacgccatcgtccgcgtgcgtgcggccggcgtgtgccggagcgatcttcacatctggcagggggagctcgcttgggtcgggattcggccgcagttgcccatcaccctgggccacgaattcggcggcgaggtggtggcggtggggcgcaatgtccgccgctttgtggcgggcgatcgcgtcaccgtcccgttccacaacggctgcggccgatgcccgcagtgccagtcgggcaggtcgaatctttgcgacgagttcggattctacggcgccacgtatgacgggtgcttcgccgaatacgtgcgtgtccccaacgccgacttcaacctcatccatttgcccgacgaggtcgatttcgtcacggcggccgccatggggtgccgctacatgacgggctttcatgctgtgatgcgggggcgcgtccagcccggtgaatgggtggccgtgcacggcgcgggcggcgtcgggctgtccgcgattcaggcggcccacgccatcggcgctcaggtgattgccgtggacatcgacgacgacaagctggagaaggcgcggaccgaaggcgccgcggtgaccatcaacagccggcgcgaggaacgcgtgttcaaggccatcaagcaggtcacgcgcggaggcgcgcacgtgagcatcgacgcgctcgggctcgccgagacggtgttcaactcggtgcggtgcctgcgcaaaggcgggcgccatgtacaggtcggcctcacctcctcgtccgagcagggcatggtggcgctgccggtcgacatcatgaccacgggcgagatcgagttcatcggaagctttggcaacccgcacgtcgccttcgacggcttgttgcggttggtcgccgcagggaggctccggcccaaggcgctcgtggagcgcgaggtgagcctcgccgagttgaacgacgtgttccatcgcatgctgcgcttcgagacgaaggggttcaacgtgatcacggcgttcgcgtga

SEQ ID NO: 972 - protein, 351 aa, Streptomyces refuineus subsp. thermotolerans; identical to SEQ ID NO: 581

SEQ ID NO: 973 - protein, 355 aa, Halorubrum lacusprofundi ATCC 49239
MRAAILREYGEPLDIHEVPDPEPGPDGAVVRVTACGVCRSDWHAWAGHGEWADDRVPRGQVLGHEPAGEVVTVGDSVDRFAPGDRVVVPFSLGDGTCPRCRQGHGNVCDDGRALGFEPEAPGAFAERVAVPDADYNLVERPPWLDATAAAALGCRYMTAYHALAERAGLDGGEWLAVHGCGGVGLSAVQLGDALGARIVAVDVDDDALSLARDLGADETVNPNDLDEETVPDRVRNLTDGGADVSVDALGIAETCRNSVRSVRPRGTHVQVGLTTEAERGEVSLPTDWMTRWEVSFVGSRGMPPTSYDDLFALVEATDVDPAALVSEELALSEVSERLAAMGEYDARGVEVVTDF

SEQ ID NO: 974 - protein, 349 aa, Propionibacterium acnes KPA171202; identical to SEQ ID NO: 582

SEQ ID NO: 975 - protein, 353 aa, Haloarcula marismortui ATCC 43049
MRAAVIEEHGEPLTIQDVPYPEPQPDQVVIETEACGVCRSDWHAWQGDWEWFGIQTGPGQILGHEPAGVVADVGADVEQFSEGDRVTVPFHLGDGSCQYCQRGHANICETSMPLGFLEAAPGAFAEAFPVREADFNCVTLPDAVDFTEMAGLGCRFMTAYHALTDRATLRPGDAVAIHGCGGVGLSAVHIADALGAEPIAVDVQDRKLDRARDLGAAATINAAEADNVPGEVHAVTDGGADVAIDALGIAETCRNAVGSLGKQGTHVQVGLTTDDEAGEIPLPVDTMTLQEIDFHGSYGMPPVRYDELFRLIDAGTLDPSQIVGETLALEDVPATLSSMGEYETVGIPVIDEF

SEQ ID NO: 976 - protein, 346 aa, Mesorhizobium loti MAFF303099
MKAVVFEKFGEAPTIQTVPDPKPAADGVVIKVEATGLCRSDWHGWMGHDDGITLPHVPGHELAGVVVAAGKQVSRWKAGDRVTVPFAVGCGRCFECSSGNHQVCEHQTQPGFTGWGSFAEYVGIEHADTNLVRLPDEMEYATAASLGCRFVTSFRAIVDQGRVKPGEWVAVHGCGGVGLSAIMIASSMGANVIAIDLTDEKLEFARKIGAVATINASTTPNVVKAVKQIANGGAHMSMDALGHPTTSFNSIANLRRRGRHVQVGLMLGEHARPQVPMDKIIAFELEILGSHGMQAYRYQAMMDMIRNGKLKPELLVGKKISLDEAPAALMAMGGFEGIGIGVVTKF

SEQ ID NO: 977 - protein, 351 aa, Artificial
  Substituion in SEQ ID NO 970
MKAARLHAFHTPFAIETVPDPEPGPEDAIVRVRAAGVCRSDLHIWQGELAWVGIRPQLPITLGHEFGGEVIAVGRNVRRFVAGDRVTVPFHNGCGRCPQCQSGRSNLCDEFGFYGATYDGCFAEYVRVPNADFNLIHLPDEVDFVTAAAMGCRYMTGFHAVMRGRVQPGEWVAVHGAGGVGLSAIQAAHAIGAQVIAVDIDDDKLEKARTEGAAVTINSRREERVFKAIKQVTRGGAHVSIDALGLAETVFNSVRCLRKGGRHVQVGLTSSSEQGMVALPVDIMTTGEIEFIGSFGNPHVAFDGLLRLVAAGRLRPKALVEREVSLAELNDVFHRMLRFETKGFNVITAFA

SEQ ID NO: 978 - protein, 351 aa, Artificial
  Substituion in SEQ ID NO 970
MKAARLHAFHTPFAIETVPDPEPGPEDAIVRVRAAGVCRSDLHIWQGELAWVGIKPQLPITLGHEFGGEVVAVGRNVRRFVAGDRVTVPFHNGCGRCPQCQSGRSNLCDEFGFYGATYDGCFAEYVRVPNADFNLIHLPDEVDFVTAAAMGCRYMTGFHAVMRGRVQPGEWVAVHGAGGVGLSAIQAAHAIGAQVIAVDIDDDKLEKARTEGAAVTINSRREERVFKAIKQVTRGGAHVSIDALGLAETVFNSVRCLRKGGRHVQVGLTSSSEQGMVALPVDIMTTGEIEFIGSFGNPHVAFDGLLRLVAAGRLRPKALVEREVSLAELNDVFHRMLRFETKGFNVITAFA

SEQ ID NO: 979 - protein, 351 aa, Artificial
  Substituion in SEQ ID NO 970
MKAARLHAFHTPFAIETVPDPEPGPEDAIVRVRAAGVCRSDLHIWQGELAWVGIRPQLPITLGHEFGGEVVAVGRNVRRFVAGDRVTVPFHNGCGRCPQCQSGRSNLCDEFGFYGATYDGCFAEYVRVPNADFNLIHLPDEVDFVTAAAMGCRYMTGFHAVMRGRVQPGEWVAVHGAGGVGLSAIQAAHAIGAQVIAVDIDDDKLEKARTEGAAVTINSRREERVFKAIKQVTRGGAHVSIDALGLAETVFNSVRCLKKGGRHVQVGLTSSSEQGMVALPVDIMTTGEIEFIGSFGNPHVAFDGLLRLVAAGRLRPKALVEREVSLAELNDVFHRMLRFETKGFNVITAFA

SEQ ID NO: 980 - protein, 351 aa, Artificial
  Substituion in SEQ ID NO 970
MKAARLHAFHTPFAIETVPDPEPGPEDAIVRVRAAGVCRSDLHIWQGELAWVGIRPQLPITLGHEFGGEVVAVGRNVRRFVAGDRVTVPFHNGCGRCPQCQSGRSNLCDDFGFYGATYDGCFAEYVRVPNADFNLIHLPDEVDFVTAAAMGCRYMTGFHAVMRGRVQPGEWVAVHGAGGVGLSAIQAAHAIGAQVIAVDIDDDKLEKARTEGAAVTINSRREERVFKAIKQVTRGGAHVSIDALGLAETVFNSVRCLRKGGRHVQVGLTSSSEQGMVALPVDIMTTGEIEFIGSFGNPHVAFDGLLRLVAAGRLRPKALVEREVSLAELNDVFHRMLRFETKGFNVITAFA

SEQ ID NO: 981 - protein, 351 aa, Artificial
  Substituion in SEQ ID NO 970
MKAARLHAFHTPFAIETVPDPEPGPEEAIVRVRAAGVCRSDLHIWQGELAWVGIRPQLPITLGHEFGGEVVAVGRNVRRFVAGDRVTVPFHNGCGRCPQCQSGRSNLCDEFGFYGATYDGCFAEYVRVPNADFNLIHLPDEVDFVTAAAMGCRYMTGFHAVMRGRVQPGEWVAVHGAGGVGLSAIQAAHAIGAQVIAVDIDDDKLEKARTEGAAVTINSRREERVFKAIKQVTRGGAHVSIDALGLAETVFNSVRCLRKGGRHVQVGLTSSSEQGMVALPVDIMTTGEIEFIGSFGNPHVAFDGLLRLVAAGRLRPKALVEREVSLAELNDVFHRMLRFETKGFNVITAFA

SEQ ID NO: 982 - DNA, 1056 bp, Artificial
  Substituion in SEQ ID NO 971
gtgaaagctgcgcgcctgcacgcattccacacgccctttgccatcgagaccgtcccagatcccgaacctggcccggaggacgccatcgtccgcgtgcgtgcggccggcgtgtgccggagcgatcttcacatctggcagggggagctcgcttgggtcgggattcggccgcagttgcccatcaccctgggccacgaattcggcggcgaggtgattgcggtggggcgcaatgtccgccgctttgtggcgggcgatcgcgtcaccgtcccgttccacaacggctgcggccgatgcccgcagtgccagtcgggcaggtcgaatctttgcgacgagttcggattctacggcgccacgtatgacgggtgcttcgccgaatacgtgcgtgtccccaacgccgacttcaacctcatccatttgcccgacgaggtcgatttcgtcacggcggccgccatggggtgccgctacatgacgggctttcatgctgtgatgcgggggcgcgtccagcccggtgaatgggtggccgtgcacggcgcgggcggcgtcgggctgtccgcgattcaggcggcccacgccatcggcgctcaggtgattgccgtggacatcgacgacgacaagctggagaaggcgcggaccgaaggcgccgcggtgaccatcaacagccggcgcgaggaacgcgtgttcaaggccatcaagcaggtcacgcgcggaggcgcgcacgtgagcatcgacgcgctcgggctcgccgagacggtgttcaactcggtgcggtgcctgcgcaaaggcgggcgccatgtacaggtcggcctcacctcctcgtccgagcagggcatggtggcgctgccggtcgacatcatgaccacgggcgagatcgagttcatcggaagctttggcaacccgcacgtcgccttcgacggcttgttgcggttggtcgccgcagggaggctccggcccaaggcgctcgtggagcgcgaggtgagcctcgccgagttgaacgacgtgttccatcgcatgctgcgcttcgagacgaaggggttcaacgtgatcacggcgttcgcgtga

SEQ ID NO: 983 - DNA, 1056 bp, Artificial
  Substituion in SEQ ID NO 971
gtgaaagctgcgcgcctgcacgcattccacacgccctttgccatcgagaccgtcccagatcccgaacctggcccggaggacgccatcgtccgcgtgcgtgcggccggcgtgtgccggagcgatcttcacatctggcagggggagctcgcttgggtcgggattaaaccgcagttgcccatcaccctgggccacgaattcggcggcgaggtggtggcggtggggcgcaatgtccgccgctttgtggcgggcgatcgcgtcaccgtcccgttccacaacggctgcggccgatgcccgcagtgccagtcgggcaggtcgaatctttgcgacgagttcggattctacggcgccacgtatgacgggtgcttcgccgaatacgtgcgtgtccccaacgccgacttcaacctcatccatttgcccgacgaggtcgatttcgtcacggcggccgccatggggtgccgctacatgacgggctttcatgctgtgatgcgggggcgcgtccagcccggtgaatgggtggccgtgcacggcgcgggcggcgtcgggctgtccgcgattcaggcggcccacgccatcggcgctcaggtgattgccgtggacatcgacgacgacaagctggagaaggcgcggaccgaaggcgccgcggtgaccatcaacagccggcgcgaggaacgcgtgttcaaggccatcaagcaggtcacgcgcggaggcgcgcacgtgagcatcgacgcgctcgggctcgccgagacggtgttcaactcggtgcggtgcctgcgcaaaggcgggcgccatgtacaggtcggcctcacctcctcgtccgagcagggcatggtggcgctgccggtcgacatcatgaccacgggcgagatcgagttcatcggaagctttggcaacccgcacgtcgccttcgacggcttgttgcggttggtcgccgcagggaggctccggcccaaggcgctcgtggagcgcgaggtgagcctcgccgagttgaacgacgtgttccatcgcatgctgcgcttcgagacgaaggggttcaacgtgatcacggcgttcgcgtga

SEQ ID NO: 984 - DNA, 1056 bp, Artificial
  Substituion in SEQ ID NO 971
gtgaaagctgcgcgcctgcacgcattccacacgccctttgccatcgagaccgtcccagatcccgaacctggcccggaggacgccatcgtccgcgtgcgtgcggccggcgtgtgccggagcgatcttcacatctggcagggggagctcgcttgggtcgggattcggccgcagttgcccatcaccctgggccacgaattcggcggcgaggtggtggcggtggggcgcaatgtccgccgctttgtggcgggcgatcgcgtcaccgtcccgttccacaacggctgcggccgatgcccgcagtgccagtcgggcaggtcgaatctttgcgacgagttcggattctacggcgccacgtatgacgggtgcttcgccgaatacgtgcgtgtccccaacgccgacttcaacctcatccatttgcccgacgaggtcgatttcgtcacggcggccgccatggggtgccgctacatgacgggctttcatgctgtgatgcgggggcgcgtccagcccggtgaatgggtggccgtgcacggcgcgggcggcgtcgggctgtccgcgattcaggcggcccacgccatcggcgctcaggtgattgccgtggacatcgacgacgacaagctggagaaggcgcggaccgaaggcgccgcggtgaccatcaacagccggcgcgaggaacgcgtgttcaaggccatcaagcaggtcacgcgcggaggcgcgcacgtgagcatcgacgcgctcgggctcgccgagacggtgttcaactcggtgcggtgcctgaaaaaaggcgggcgccatgtacaggtcggcctcacctcctcgtccgagcagggcatggtggcgctgccggtcgacatcatgaccacgggcgagatcgagttcatcggaagctttggcaacccgcacgtcgccttcgacggcttgttgcggttggtcgccgcagggaggctccggcccaaggcgctcgtggagcgcgaggtgagcctcgccgagttgaacgacgtgttccatcgcatgctgcgcttcgagacgaaggggttcaacgtgatcacggcgttcgcgtga

SEQ ID NO: 985 - DNA, 1056 bp, Artificial
  Substituion in SEQ ID NO 971
gtgaaagctgcgcgcctgcacgcattccacacgccctttgccatcgagaccgtcccagatcccgaacctggcccggaggacgccatcgtccgcgtgcgtgcggccggcgtgtgccggagcgatcttcacatctggcagggggagctcgcttgggtcgggattcggccgcagttgcccatcaccctgggccacgaattcggcggcgaggtggtggcggtggggcgcaatgtccgccgctttgtggcgggcgatcgcgtcaccgtcccgttccacaacggctgcggccgatgcccgcagtgccagtcgggcaggtcgaatctttgcgacgatttcggattctacggcgccacgtatgacgggtgcttcgccgaatacgtgcgtgtccccaacgccgacttcaacctcatccatttgcccgacgaggtcgatttcgtcacggcggccgccatggggtgccgctacatgacgggctttcatgctgtgatgcgggggcgcgtccagcccggtgaatgggtggccgtgcacggcgcgggcggcgtcgggctgtccgcgattcaggcggcccacgccatcggcgctcaggtgattgccgtggacatcgacgacgacaagctggagaaggcgcggaccgaaggcgccgcggtgaccatcaacagccggcgcgaggaacgcgtgttcaaggccatcaagcaggtcacgcgcggaggcgcgcacgtgagcatcgacgcgctcgggctcgccgagacggtgttcaactcggtgcggtgcctgcgcaaaggcgggcgccatgtacaggtcggcctcacctcctcgtccgagcagggcatggtggcgctgccggtcgacatcatgaccacgggcgagatcgagttcatcggaagctttggcaacccgcacgtcgccttcgacggcttgttgcggttggtcgccgcagggaggctccggcccaaggcgctcgtggagcgcgaggtgagcctcgccgagttgaacgacgtgttccatcgcatgctgcgcttcgagacgaaggggttcaacgtgatcacggcgttcgcgtga

SEQ ID NO: 986 - DNA, 1056 bp, Artificial
  Substituion in SEQ ID NO 971
gtgaaagctgcgcgcctgcacgcattccacacgccctttgccatcgagaccgtcccagatcccgaacctggcccggaggaagccatcgtccgcgtgcgtgcggccggcgtgtgccggagcgatcttcacatctggcagggggagctcgcttgggtcgggattcggccgcagttgcccatcaccctgggccacgaattcggcggcgaggtggtggcggtggggcgcaatgtccgccgctttgtggcgggcgatcgcgtcaccgtcccgttccacaacggctgcggccgatgcccgcagtgccagtcgggcaggtcgaatctttgcgacgagttcggattctacggcgccacgtatgacgggtgcttcgccgaatacgtgcgtgtccccaacgccgacttcaacctcatccatttgcccgacgaggtcgatttcgtcacggcggccgccatggggtgccgctacatgacgggctttcatgctgtgatgcgggggcgcgtccagcccggtgaatgggtggccgtgcacggcgcgggcggcgtcgggctgtccgcgattcaggcggcccacgccatcggcgctcaggtgattgccgtggacatcgacgacgacaagctggagaaggcgcggaccgaaggcgccgcggtgaccatcaacagccggcgcgaggaacgcgtgttcaaggccatcaagcaggtcacgcgcggaggcgcgcacgtgagcatcgacgcgctcgggctcgccgagacggtgttcaactcggtgcggtgcctgcgcaaaggcgggcgccatgtacaggtcggcctcacctcctcgtccgagcagggcatggtggcgctgccggtcgacatcatgaccacgggcgagatcgagttcatcggaagctttggcaacccgcacgtcgccttcgacggcttgttgcggttggtcgccgcagggaggctccggcccaaggcgctcgtggagcgcgaggtgagcctcgccgagttgaacgacgtgttccatcgcatgctgcgcttcgagacgaaggggttcaacgtgatcacggcgttcgcgtga

SEQ ID NO: 987 - protein, 377 aa, Alicyclobacillus acidocaldarius
MQTRAAVLMEMGARPPYASTRPLRLETLELEPPGPGEVLIRVRAAGLCHSDLSVIEGARPRPMPMALGHEAAGEVVELGEGVTDLAPGDHVVCAFVPSCGHCAPCQEGRPALCEPGAEANGRGTLLSGARRLRLGGQPVHHHLGVSAFSDYAVVSRRSLVRIDPSLPFEHAALFGCAVMTGVGAIVNTARVPVGASVGIVGLGGVGLAALLGAVASSARHIAAIDVNPEKLAFARELGATHTYDARDPGVIDKVRADSAGGLEYVFETAGSVAAMKTAFMVTRRGGTTVTTGLPDPRHEWSVPQVLLAAEERTIRGSYVGSCIPSRDIPRFISLFQQGKLPVDRLVSDVIDLDHINEGFDRLAAGEAVRIVVRMSGA

SEQ ID NO: 988 - DNA, 1134 bp, Alicyclobacillus acidocaldarius
gtgcagacgcgagccgctgtcctcatggagatgggggcgaggccgccttatgcatccacaaggccgcttcgcctggagacgctggaactggaaccgccagggccgggcgaggtcctcatccgggtgcgcgccgccggcctgtgtcattcggatctgtccgtcattgagggcgcccgcccgcggccgatgccgatggcccttggccacgaggcggctggcgaggtggtggagctcggcgaaggagtgacggacctcgcgccgggcgatcacgtcgtctgcgcctttgtgccaagctgcgggcactgcgccccctgtcaagagggccggccagcgctctgcgagccgggcgccgaggccaacggccgcggcacgctgctctccggcgcgcgcaggctgcgccttggcggacagcccgtccatcaccacctcggcgtgtcggccttcagcgactacgccgtcgtctcgcgccgctcgctggtgagaatcgatccgtccctcccgttcgagcacgcggcgctgtttggctgcgcggtcatgacgggcgtcggcgcgatcgtcaacacggcgcgcgtccctgtaggcgcctcggtcggcatcgtcggcctcggcggggtgggactcgccgcgctgctcggcgcggtggcttcgtccgcccggcacatcgcggccatcgacgtgaaccccgagaaactggcgttcgcgcgcgaactcggcgcaacgcacacgtacgacgcgcgcgatcccggcgtgattgacaaggtgcgcgcggattcggcgggcggcttggagtacgtgttcgagacggcgggctccgtcgcggccatgaagacggcgttcatggtgacgcggcgcggcggcacgaccgtgaccacagggctgccggatcctcggcacgagtggagcgtgccccaggtgctgcttgcggccgaggagcgcaccattcggggctcgtacgtcggaagctgcatcccgtcccgcgacatcccgcgcttcatttccttgtttcagcaagggaagctccctgtcgaccggctcgtgtcggacgtgatcgatctcgaccacatcaacgagggcttcgaccgcctggctgcgggtgaggcggtgcgcatcgtggtgcgaatgagtggtgcctaa

SEQ ID NO: 989 - protein, 375 aa, Staphylococcus saprophyticus subsp. saprophyticus ATCC 15305
MKTRAAVLREMGKDAPYTESHPLTIETLELQGPQSNEVLIKIGAVGLCHSDLSVINGSRPRPMPMVLGHEAAGEIIEVGENVAEFEVGDHIVCTFIPSCGHCIPCREGRPALCENGAAANEKGEMLEGGFRYESDRDEVMHHHLGVSGFADYAVVSTNSIVKVDKKIPFEKVAIFGCAVITGIGAVINTARINAGSTVAVVGLGGIGLNAILGARLAGASEIIALDINEEKFALAKSLGATAVFNSGEAHTIEDIKQYTQGGVDYAFETAGVVPAMDVAYQITRRGGMTTTTGLPDPKHQFSFPQVTLAAEERTIKGSYVGSCVPDRDIPRFINLYHQGRLPVNELLTDTLPLEHINEGFDRLARGEAARLVVKM

SEQ ID NO: 990 - protein, 374 aa, Oceanobacillus iheyensis HTE831
MQVKTAVLRTQGADSPYKESKPIKIETLELDAPQLGEVLIQIKAASLCHSDLSVINGSRPRPLPMALGHEASGVVVEVGEGVTYLEPGDHIVCVFVPSCGHCVPCKEGRPALCEPGADSNTAGTLISGGIRLHADGEAINHHLGVSAFSEFAVVSRNSLVKVKKDIPFEKLALFGCAVITGVGAVVNTANVKLGSTVAIVGLGGIGLSALLGAVAAGASRIIAVDINENKLKQAKELGATDVFNSTEETVIQQIKEATDGGVNYAFETAGAVPAMEVAYGITKRGGTTVTTGLPHPEHQFSFPYVTLTAEEKTLKGSYVGSCVPDRDIPRYMNLFKQDRLPVDKLMTDFISLDEINEGFDKLAKGDSSRIIIKM

SEQ ID NO: 991 - protein, 374 aa, Staphylococcus epidermidis RP62A
MKTRAAVLYEMGAKKPYKESKPLKIEYLELDNPSEHEVLIKIHAAGLCHSDLSVINGNRPRPLPMALGHEASGEVIKVGKAVTRVSEGDHVVCTFIPSCGKCIPCKEGRPALCENGAISNEKGEMLEGGMRLSNDEGKVYHHLGISGFAEYSVVSENSIVKIDKKIPFERAAAFGCAIITGIGAVVNTAQIRSGSNVAVVGLGGIGLNAIIGAKLAGANEIIALDINEDKFELAKQFGATATFNSSDKDIDEQIKEYIPGGVEYAFETAGVVPAMKVAYQITKRGGTTVTTGLPNPKDNFSFPQVTLAAEERTIKGSYVGSCVPDRDIPRFVNLYNQGRLNIDSLISEVITLDEINEGFDRLSNGEVGRIIMKM

SEQ ID NO: 992 - protein, 374 aa, Staphylococcus haemolyticus JCSC1435
MKTRAAVLYEMEASQPYKESKPLKIESLELEDPHEHEVLLKIHAAGLCHSDLSVINGSRPRPLPMALGHEATGEVLKVGSSVTRVKEGDHVVCTFIPSCGKCIPCKEGRPALCENGAKANEKGEMLEGGIRLSNEDGQVYHHLGVSGFAEHAVVSENSIVKISNEIPFERAAVFGCAVITGIGAVMNTAQIRPGSNVAVVGLGGIGLNAIIGAKLAGANEIIALDINEDKFDLAKQFGATATFNSSDDDIDEQIKEYVPGGVEYAFETAGVVPAMQVAYRITKRGGTTVTTGLPHPKDEFSFPQVTLAAEERTVKGSYVGSCVPDRDIPRFVSLYKQGRLNIDPLISEVITLDDINEGFDKLASGDVGRIIVKM

SEQ ID NO: 993 - protein, 370 aa, Aurantimonas sp. SI85-9A1
TRAAVLRRSPVEGPYATSRPLSIETVELAPPGDGEVLVRIKAAGLCHSDLSVIDGVRPRPTPMVLGHEAAGIVETVGAGVDDLAPGDHVVMVFVPSCGHCSPCAEGRPALCEPGNARNGEGTLLSGERRLSCEGEPVHHHLGVSAFAERSVLSRRSLIKIDPELPLEIAALFGCAVLTGVGAVVNTGRVKAGETVAVVGLGGVGLSAILGAVAAGASRIIAVDLQADKLDMAKTLGATDIFNAGEAGVADAVRAATGGGVDHAFEMAGSARALELAFAITRRGGATVTAGLTPPTATMALSPLKLVAEERTLKGSYVGSCIPSRDIPRYIALYRGGRLPVDRLLTSRGTLDDINEGFDALAAGRTVRHVV

SEQ ID NO: 994 - protein, 377 aa, Artificial
  Substituion in SEQ ID NO 987
MQTRAAVLMEMGARPPYASTRPLRLETLELEPPGPGEVLIRVRAAGLCHSDLSVIEGARPRPMPMALGHEAAGEVVELGEGVTDLAPGDHVVCAFVPSCGHCAPCQEGRPALCEPGAEANGRGTLLSGARRLRLGGQPVHHHLGVSAFSDYAVVSRRSLVRIDPSLPFEHAALFGCAVMTGVGAIVNTARVPVGASVGIVGLGGVGLAALLGAVASSARHIAAIDVNPEKLAFARELGATHTYDARDPGVIDKVRADSAGGLEYVFETAGSVAAMKTAFMVTRRGGTTVTTGLPDPRHEWSVPQVLLAAEERTIRGSYVGSCIPSRDIPRFISLFQQGKLPVDRLVSDIIDLDHINEGFDRLAAGEAVRIVVRMSGA

SEQ ID NO: 995 - protein, 377 aa, Artificial
  Substituion in SEQ ID NO 987
MQTRAAVLMEMGARPPYASTRPLRLETLELEPPGPGEVLIRVRAAGLCHSDLSVIEGARPRPMPMALGHEAAGEVVELGEGVTDLAPGDHVVCAFVPSCGHCAPCQEGRPALCEPGAEANGRGTLLSGARRLRLGGQPVHHHLGVSAFSDYAVVSRRSLVRIDPSLPFEHAALFGCAVMTGVGAIVNTARVPVGASVGIVGLGGVGLAALLGAVASSARHIAAIDVNPEKLAFARELGATHTYDARDPGVIDKVRADSAGGLEYVFETAGSVAAMKTAFMVTRRGGTTVTTGLPDPRHDWSVPQVLLAAEERTIRGSYVGSCIPSRDIPRFISLFQQGKLPVDRLVSDVIDLDHINEGFDRLAAGEAVRIVVRMSGA

SEQ ID NO: 996 - protein, 377 aa, Artificial
  Substituion in SEQ ID NO 987
MQTRAAVLMEMGARPPYASTRPLRLETLELEPPGPGEVLIRVRAAGLCHSDLSVIEGARPRPMPMALGHEAAGEVVELGEGVTELAPGDHVVCAFVPSCGHCAPCQEGRPALCEPGAEANGRGTLLSGARRLRLGGQPVHHHLGVSAFSDYAVVSRRSLVRIDPSLPFEHAALFGCAVMTGVGAIVNTARVPVGASVGIVGLGGVGLAALLGAVASSARHIAAIDVNPEKLAFARELGATHTYDARDPGVIDKVRADSAGGLEYVFETAGSVAAMKTAFMVTRRGGTTVTTGLPDPRHEWSVPQVLLAAEERTIRGSYVGSCIPSRDIPRFISLFQQGKLPVDRLVSDVIDLDHINEGFDRLAAGEAVRIVVRMSGA

SEQ ID NO: 997 - protein, 377 aa, Artificial
  Substituion in SEQ ID NO 987
MQTRAAVLMEMGARPPYASTRPLRLETLELEPPGPGEVLIRVRAAGLCHSDLSVIEGARPRPMPMALGHEAAGEVVELGEGVTDLAPGDHVVCAFVPSCGHCAPCNEGRPALCEPGAEANGRGTLLSGARRLRLGGQPVHHHLGVSAFSDYAVVSRRSLVRIDPSLPFEHAALFGCAVMTGVGAIVNTARVPVGASVGIVGLGGVGLAALLGAVASSARHIAAIDVNPEKLAFARELGATHTYDARDPGVIDKVRADSAGGLEYVFETAGSVAAMKTAFMVTRRGGTTVTTGLPDPRHEWSVPQVLLAAEERTIRGSYVGSCIPSRDIPRFISLFQQGKLPVDRLVSDVIDLDHINEGFDRLAAGEAVRIVVRMSGA

SEQ ID NO: 998 - protein, 377 aa, Artificial
  Substituion in SEQ ID NO 987
MQTRAAVLMEMGARPPYASTRPLRLETLELEPPGPGEVLIRVRAAGLCHSDLSVIEGARPRPMPMALGHEAAGEVVELGEGVTDLAPGDHVVCAFVPSCGHCAPCQEGRPALCEPGAEANGRGTLLSGARRLRLGGQPVHHHLGVSAFSDYAVVSRRSLVRIDPSLPFEHAALFGCAVMTGVGAIVNTARVPVGASVGIVGLGGVGLAALLGAVASSARHIAAIDVNPEKLAFARELGATHTYDARDPGVIDKVRADSAGGLEYVFETAGSVAAMKTAFMVTRRGGTTVTTGLPDPRHEWSVPQVLLAAEERTIRGSYVGSCIPSRDIPRFISLFQQGKLPVDRLVSDVLDLDHINEGFDRLAAGEAVRIVVRMSGA

SEQ ID NO: 999 - DNA, 1134 bp, Artificial
  Substituion in SEQ ID NO 988
gtgcagacgcgagccgctgtcctcatggagatgggggcgaggccgccttatgcatccacaaggccgcttcgcctggagacgctggaactggaaccgccagggccgggcgaggtcctcatccgggtgcgcgccgccggcctgtgtcattcggatctgtccgtcattgagggcgcccgcccgcggccgatgccgatggcccttggccacgaggcggctggcgaggtggtggagctcggcgaaggagtgacggacctcgcgccgggcgatcacgtcgtctgcgcctttgtgccaagctgcgggcactgcgccccctgtcaagagggccggccagcgctctgcgagccgggcgccgaggccaacggccgcggcacgctgctctccggcgcgcgcaggctgcgccttggcggacagcccgtccatcaccacctcggcgtgtcggccttcagcgactacgccgtcgtctcgcgccgctcgctggtgagaatcgatccgtccctcccgttcgagcacgcggcgctgtttggctgcgcggtcatgacgggcgtcggcgcgatcgtcaacacggcgcgcgtccctgtaggcgcctcggtcggcatcgtcggcctcggcggggtgggactcgccgcgctgctcggcgcggtggcttcgtccgcccggcacatcgcggccatcgacgtgaaccccgagaaactggcgttcgcgcgcgaactcggcgcaacgcacacgtacgacgcgcgcgatcccggcgtgattgacaaggtgcgcgcggattcggcgggcggcttggagtacgtgttcgagacggcgggctccgtcgcggccatgaagacggcgttcatggtgacgcggcgcggcggcacgaccgtgaccacagggctgccggatcctcggcacgagtggagcgtgccccaggtgctgcttgcggccgaggagcgcaccattcggggctcgtacgtcggaagctgcatcccgtcccgcgacatcccgcgcttcatttccttgtttcagcaagggaagctccctgtcgaccggctcgtgtcggacattatcgatctcgaccacatcaacgagggcttcgaccgcctggctgcgggtgaggcggtgcgcatcgtggtgcgaatgagtggtgcctaa

SEQ ID NO: 1000 - DNA, 1134 bp, Artificial
  Substituion in SEQ ID NO 988
gtgcagacgcgagccgctgtcctcatggagatgggggcgaggccgccttatgcatccacaaggccgcttcgcctggagacgctggaactggaaccgccagggccgggcgaggtcctcatccgggtgcgcgccgccggcctgtgtcattcggatctgtccgtcattgagggcgcccgcccgcggccgatgccgatggcccttggccacgaggcggctggcgaggtggtggagctcggcgaaggagtgacggacctcgcgccgggcgatcacgtcgtctgcgcctttgtgccaagctgcgggcactgcgccccctgtcaagagggccggccagcgctctgcgagccgggcgccgaggccaacggccgcggcacgctgctctccggcgcgcgcaggctgcgccttggcggacagcccgtccatcaccacctcggcgtgtcggccttcagcgactacgccgtcgtctcgcgccgctcgctggtgagaatcgatccgtccctcccgttcgagcacgcggcgctgtttggctgcgcggtcatgacgggcgtcggcgcgatcgtcaacacggcgcgcgtccctgtaggcgcctcggtcggcatcgtcggcctcggcggggtgggactcgccgcgctgctcggcgcggtggcttcgtccgcccggcacatcgcggccatcgacgtgaaccccgagaaactggcgttcgcgcgcgaactcggcgcaacgcacacgtacgacgcgcgcgatcccggcgtgattgacaaggtgcgcgcggattcggcgggcggcttggagtacgtgttcgagacggcgggctccgtcgcggccatgaagacggcgttcatggtgacgcggcgcggcggcacgaccgtgaccacagggctgccggatcctcggcacgattggagcgtgccccaggtgctgcttgcggccgaggagcgcaccattcggggctcgtacgtcggaagctgcatcccgtcccgcgacatcccgcgcttcatttccttgtttcagcaagggaagctccctgtcgaccggctcgtgtcggacgtgatcgatctcgaccacatcaacgagggcttcgaccgcctggctgcgggtgaggcggtgcgcatcgtggtgcgaatgagtggtgcctaa

SEQ ID NO: 1001 - DNA, 1134 bp, Artificial
  Substituion in SEQ ID NO 988
gtgcagacgcgagccgctgtcctcatggagatgggggcgaggccgccttatgcatccacaaggccgcttcgcctggagacgctggaactggaaccgccagggccgggcgaggtcctcatccgggtgcgcgccgccggcctgtgtcattcggatctgtccgtcattgagggcgcccgcccgcggccgatgccgatggcccttggccacgaggcggctggcgaggtggtggagctcggcgaaggagtgacggaactcgcgccgggcgatcacgtcgtctgcgcctttgtgccaagctgcgggcactgcgccccctgtcaagagggccggccagcgctctgcgagccgggcgccgaggccaacggccgcggcacgctgctctccggcgcgcgcaggctgcgccttggcggacagcccgtccatcaccacctcggcgtgtcggccttcagcgactacgccgtcgtctcgcgccgctcgctggtgagaatcgatccgtccctcccgttcgagcacgcggcgctgtttggctgcgcggtcatgacgggcgtcggcgcgatcgtcaacacggcgcgcgtccctgtaggcgcctcggtcggcatcgtcggcctcggcggggtgggactcgccgcgctgctcggcgcggtggcttcgtccgcccggcacatcgcggccatcgacgtgaaccccgagaaactggcgttcgcgcgcgaactcggcgcaacgcacacgtacgacgcgcgcgatcccggcgtgattgacaaggtgcgcgcggattcggcgggcggcttggagtacgtgttcgagacggcgggctccgtcgcggccatgaagacggcgttcatggtgacgcggcgcggcggcacgaccgtgaccacagggctgccggatcctcggcacgagtggagcgtgccccaggtgctgcttgcggccgaggagcgcaccattcggggctcgtacgtcggaagctgcatcccgtcccgcgacatcccgcgcttcatttccttgtttcagcaagggaagctccctgtcgaccggctcgtgtcggacgtgatcgatctcgaccacatcaacgagggcttcgaccgcctggctgcgggtgaggcggtgcgcatcgtggtgcgaatgagtggtgcctaa

SEQ ID NO: 1002 - DNA, 1134 bp, Artificial
  Substituion in SEQ ID NO 988
gtgcagacgcgagccgctgtcctcatggagatgggggcgaggccgccttatgcatccacaaggccgcttcgcctggagacgctggaactggaaccgccagggccgggcgaggtcctcatccgggtgcgcgccgccggcctgtgtcattcggatctgtccgtcattgagggcgcccgcccgcggccgatgccgatggcccttggccacgaggcggctggcgaggtggtggagctcggcgaaggagtgacggacctcgcgccgggcgatcacgtcgtctgcgcctttgtgccaagctgcgggcactgcgccccctgtaatgagggccggccagcgctctgcgagccgggcgccgaggccaacggccgcggcacgctgctctccggcgcgcgcaggctgcgccttggcggacagcccgtccatcaccacctcggcgtgtcggccttcagcgactacgccgtcgtctcgcgccgctcgctggtgagaatcgatccgtccctcccgttcgagcacgcggcgctgtttggctgcgcggtcatgacgggcgtcggcgcgatcgtcaacacggcgcgcgtccctgtaggcgcctcggtcggcatcgtcggcctcggcggggtgggactcgccgcgctgctcggcgcggtggcttcgtccgcccggcacatcgcggccatcgacgtgaaccccgagaaactggcgttcgcgcgcgaactcggcgcaacgcacacgtacgacgcgcgcgatcccggcgtgattgacaaggtgcgcgcggattcggcgggcggcttggagtacgtgttcgagacggcgggctccgtcgcggccatgaagacggcgttcatggtgacgcggcgcggcggcacgaccgtgaccacagggctgccggatcctcggcacgagtggagcgtgccccaggtgctgcttgcggccgaggagcgcaccattcggggctcgtacgtcggaagctgcatcccgtcccgcgacatcccgcgcttcatttccttgtttcagcaagggaagctccctgtcgaccggctcgtgtcggacgtgatcgatctcgaccacatcaacgagggcttcgaccgcctggctgcgggtgaggcggtgcgcatcgtggtgcgaatgagtggtgcctaa

SEQ ID NO: 1003 - DNA, 1134 bp, Artificial
  Substituion in SEQ ID NO 988
gtgcagacgcgagccgctgtcctcatggagatgggggcgaggccgccttatgcatccacaaggccgcttcgcctggagacgctggaactggaaccgccagggccgggcgaggtcctcatccgggtgcgcgccgccggcctgtgtcattcggatctgtccgtcattgagggcgcccgcccgcggccgatgccgatggcccttggccacgaggcggctggcgaggtggtggagctcggcgaaggagtgacggacctcgcgccgggcgatcacgtcgtctgcgcctttgtgccaagctgcgggcactgcgccccctgtcaagagggccggccagcgctctgcgagccgggcgccgaggccaacggccgcggcacgctgctctccggcgcgcgcaggctgcgccttggcggacagcccgtccatcaccacctcggcgtgtcggccttcagcgactacgccgtcgtctcgcgccgctcgctggtgagaatcgatccgtccctcccgttcgagcacgcggcgctgtttggctgcgcggtcatgacgggcgtcggcgcgatcgtcaacacggcgcgcgtccctgtaggcgcctcggtcggcatcgtcggcctcggcggggtgggactcgccgcgctgctcggcgcggtggcttcgtccgcccggcacatcgcggccatcgacgtgaaccccgagaaactggcgttcgcgcgcgaactcggcgcaacgcacacgtacgacgcgcgcgatcccggcgtgattgacaaggtgcgcgcggattcggcgggcggcttggagtacgtgttcgagacggcgggctccgtcgcggccatgaagacggcgttcatggtgacgcggcgcggcggcacgaccgtgaccacagggctgccggatcctcggcacgagtggagcgtgccccaggtgctgcttgcggccgaggagcgcaccattcggggctcgtacgtcggaagctgcatcccgtcccgcgacatcccgcgcttcatttccttgtttcagcaagggaagctccctgtcgaccggctcgtgtcggacgtgttagatctcgaccacatcaacgagggcttcgaccgcctggctgcgggtgaggcggtgcgcatcgtggtgcgaatgagtggtgcctaa

SEQ ID NO: 1004 - protein, 213 aa, Alicyclobacillus acidocaldarius
MLTVAMAKGRTLDDVVPLWEEAGIPYPRDWDESRALVFEIPWRDWTLRYLLAKPADVPTYVAYGVADLGIVGNDILLEQEREMYELLDLGVARCKLCVAGREEERRHAPRRVATKYPKLADRYFRSQGHQVEIVPLAGSIELASVIGLTDRIFDLVQTGETLRANGLVVFDEVLDISARLVANRSSYRMKHREISACLERLEAAVARRNAYAP

SEQ ID NO: 1005 - DNA, 642 bp, Alicyclobacillus acidocaldarius
atgttgaccgtggcgatggccaaggggcgcacgctggacgacgtggtgccgctctgggaagaggccggcatcccgtatccgcgcgactgggacgagagccgcgcgctcgtgttcgagatcccttggcgagactggaccctgcggtacctcctcgccaagccggccgacgtgcccacgtacgtcgcctacggtgtggccgatctcggcattgtcggcaacgacatcctgctcgaacaggagcgggagatgtacgagctgctcgatctcggcgtcgcgcgctgcaagctctgcgtcgccgggcgcgaagaggagcgccgccacgcgccgcgccgcgtggcgaccaaatacccgaagctcgccgaccggtactttcgcagccaggggcaccaggtggagattgtgccgctcgcggggtccatcgagctcgccagcgtgattggcctgacggatcgcatcttcgatctcgtccagaccggcgagacgctccgggccaacgggctcgtggtgttcgacgaggtgctcgacatctccgcgaggctcgtggccaaccgatccagctaccggatgaagcaccgagaaatctcggcctgcctggagcgcctggaggcggccgtcgcgaggaggaacgcgtatgcgccttga

SEQ ID NO: 1006 - protein, 204 aa, Bacillus sp. SG-1
LTIAMPKGRIFDEALELLRQAGYNLPPEFDDSRKLIIEVPEEKLTFILAKPMDVPTYVEHGVADLGIAGKDVMLEEERDVYELLDLKISACYLAVAGLPGTKMNEVAPKIATKYPTIASSYFREQGEQVEIIKLNGSIELAPMIGLADRIVDIVSTGRTLKENGLVEYEKIVDITSRLIVNPVSYRMKDERIDELAERLREVVS

SEQ ID NO: 1007 - protein, 201 aa, Bacillus halodurans C-125
MLTVAMPKGRIFDEAVGLLRKAGYNLPAEFEASRKLIVDVPEENMRFILAKPMDVPTYVEHGVADVGVAGKDVMLEEERDVYEVLDLKISECYLAVAGLPNYEKKHDLNPKVASKYPHLATRYFKEQGEQVEIIKLNGSIELAPLIGLADRIVDIVSTGRTLRENGLVELEKMMTITSRLIVNPVSYRMKDERIDEMVERL

SEQ ID NO: 1008 - protein, 204 aa, Geobacillus kaustophilus HTA426
MLTIAMPKGRIFEEAVELLRRADYALPPEFTESRKLVIDVPEENMRFILAKPMDVVTYVEHGVADLGIAGKDVLMEEERDVYELLDLHISRCHLAVAGMPGAKMNEIAPRVATKYPNIASTYFREQGEQVEIIRLNGSIELAPLIGLADRIVDIVSTGRTLRENGLVELERIAEVTSRLIVNPASYRLNGGDIERLVDRLAAVI

SEQ ID NO: 1009 - protein, 208 aa, Bacillus licheniformis ATCC 14580
LTIAMPKGRIFEEAADMLRKAGYQLPEEFDDSRKLIIQVPEENLRFILAKPMDVTTYVEHGVADVGIAGKDVLLEEERDVYEVLDLNISKCRLAVAGLPETAADTVAPRVATKYPNVASSYFREQGEQVEIIKLNGSIELAPLIGLAGRIVDIVSTGQTLRENGLVETEKICDITSRLIVNPVSYRMKDAVIDEMASRLSLIVEGEKA

SEQ ID NO: 1010 - protein, 209 aa, Bacillus sp. NRRL B-14911
LLTIAMPKGRIFEEAAELLRQAGFDLPPEFDDSRKLIIDVEEERFQFILAKPMDVPTYVEHGVADLGIAGKDVMLEEERDIYELLDLKISACYLAVAGIPGTKMNEVAPKVATKYPNVAAAYFREQGEQVEIIKLNGSIELAPLIGLSDRIVDIVSTGRTLKENGLVEYEQIVGITSRLIVNPVSYRIKDKRISEIVDKLSRVVNEQAA

SEQ ID NO: 1011 - protein, 213 aa, Artificial
  Substituion in SEQ ID NO 1004
MLTVAMAKGRTLDDVVPLWEEAGIPYPRDWDESRALVFEIPWRDWTLRYLLAKPADVPTYVAYGVADLGIVGNDILLEQEREMYELLDLGVARCKLCVAGREEERRHAPRRVATKYPKLADRYFRSQGHQVEIVPLAGSIELASVIGLTDRIFDLVQTGETLRANGLVIFDEVLDISARLVANRSSYRMKHREISACLERLEAAVARRNAYAP

SEQ ID NO: 1012 - protein, 213 aa, Artificial
  Substituion in SEQ ID NO 1004
MLTVAMAKGRTLDDVVPLWEEAGIPYPRDWDESRALVFEIPWRDWTLRYLLAKPADVPTYVAYGVADLGIVGNDILLEQEREMYELLDLGVARCKLCVAGREEERRHAPRRVATKYPRLADRYFRSQGHQVEIVPLAGSIELASVIGLTDRIFDLVQTGETLRANGLVVFDEVLDISARLVANRSSYRMKHREISACLERLEAAVARRNAYAP

SEQ ID NO: 1013 - protein, 213 aa, Artificial
  Substituion in SEQ ID NO 1004
MLTVAMAKGRTLDDVIPLWEEAGIPYPRDWDESRALVFEIPWRDWTLRYLLAKPADVPTYVAYGVADLGIVGNDILLEQEREMYELLDLGVARCKLCVAGREEERRHAPRRVATKYPKLADRYFRSQGHQVEIVPLAGSIELASVIGLTDRIFDLVQTGETLRANGLVVFDEVLDISARLVANRSSYRMKHREISACLERLEAAVARRNAYAP

SEQ ID NO: 1014 - protein, 213 aa, Artificial
  Substituion in SEQ ID NO 1004
MLTVAMAKGRTLDDVVPLWEEAGIPYPRDWDESRALVFEIPWRDWTLRYLLAKPADVPTYVAYGVADLGIVGNDILLEQEREMYELLDLGVARCKLCVAGREEERRHAPRRVATKYPKLADRYFRSQGHQVEIVPLAGSIELASVIGLTDRIFDLVQTGETLRANGLVVFDEVLDISARLVANRSSYRMKHREISACIERLEAAVARRNAYAP

SEQ ID NO: 1015 - protein, 213 aa, Artificial
  Substituion in SEQ ID NO 1004
MLTVAMAKGRTLDDVVPLWEEAGIPYPRDWDESRALVFEIPWRDWTLRYLLAKPADVPTYVAYGVADLGIVGNDILLEQEREMYELLDLGVARCKLCVAGREEERRHAPRRVATKYPKLADRYFRSQGHQVEIVPLAGSIELASVIGLTDRIFDLVQTGETLRANGLVVFDEVLDISARLVANKSSYRMKHREISACLERLEAAVARRNAYAP

SEQ ID NO: 1016 - DNA, 642 bp, Artificial
  Substituion in SEQ ID NO 1005
atgttgaccgtggcgatggccaaggggcgcacgctggacgacgtggtgccgctctgggaagaggccggcatcccgtatccgcgcgactgggacgagagccgcgcgctcgtgttcgagatcccttggcgagactggaccctgcggtacctcctcgccaagccggccgacgtgcccacgtacgtcgcctacggtgtggccgatctcggcattgtcggcaacgacatcctgctcgaacaggagcgggagatgtacgagctgctcgatctcggcgtcgcgcgctgcaagctctgcgtcgccgggcgcgaagaggagcgccgccacgcgccgcgccgcgtggcgaccaaatacccgaagctcgccgaccggtactttcgcagccaggggcaccaggtggagattgtgccgctcgcggggtccatcgagctcgccagcgtgattggcctgacggatcgcatcttcgatctcgtccagaccggcgagacgctccgggccaacgggctcgtgattttcgacgaggtgctcgacatctccgcgaggctcgtggccaaccgatccagctaccggatgaagcaccgagaaatctcggcctgcctggagcgcctggaggcggccgtcgcgaggaggaacgcgtatgcgccttga

SEQ ID NO: 1017 - DNA, 642 bp, Artificial
  Substituion in SEQ ID NO 1005
atgttgaccgtggcgatggccaaggggcgcacgctggacgacgtggtgccgctctgggaagaggccggcatcccgtatccgcgcgactgggacgagagccgcgcgctcgtgttcgagatcccttggcgagactggaccctgcggtacctcctcgccaagccggccgacgtgcccacgtacgtcgcctacggtgtggccgatctcggcattgtcggcaacgacatcctgctcgaacaggagcgggagatgtacgagctgctcgatctcggcgtcgcgcgctgcaagctctgcgtcgccgggcgcgaagaggagcgccgccacgcgccgcgccgcgtggcgaccaaatacccgcgtctcgccgaccggtactttcgcagccaggggcaccaggtggagattgtgccgctcgcggggtccatcgagctcgccagcgtgattggcctgacggatcgcatcttcgatctcgtccagaccggcgagacgctccgggccaacgggctcgtggtgttcgacgaggtgctcgacatctccgcgaggctcgtggccaaccgatccagctaccggatgaagcaccgagaaatctcggcctgcctggagcgcctggaggcggccgtcgcgaggaggaacgcgtatgcgccttga

SEQ ID NO: 1018 - DNA, 642 bp, Artificial
  Substituion in SEQ ID NO 1005
atgttgaccgtggcgatggccaaggggcgcacgctggacgacgtgattccgctctgggaagaggccggcatcccgtatccgcgcgactgggacgagagccgcgcgctcgtgttcgagatcccttggcgagactggaccctgcggtacctcctcgccaagccggccgacgtgcccacgtacgtcgcctacggtgtggccgatctcggcattgtcggcaacgacatcctgctcgaacaggagcgggagatgtacgagctgctcgatctcggcgtcgcgcgctgcaagctctgcgtcgccgggcgcgaagaggagcgccgccacgcgccgcgccgcgtggcgaccaaatacccgaagctcgccgaccggtactttcgcagccaggggcaccaggtggagattgtgccgctcgcggggtccatcgagctcgccagcgtgattggcctgacggatcgcatcttcgatctcgtccagaccggcgagacgctccgggccaacgggctcgtggtgttcgacgaggtgctcgacatctccgcgaggctcgtggccaaccgatccagctaccggatgaagcaccgagaaatctcggcctgcctggagcgcctggaggcggccgtcgcgaggaggaacgcgtatgcgccttga

SEQ ID NO: 1019 - DNA, 642 bp, Artificial
  Substituion in SEQ ID NO 1005
atgttgaccgtggcgatggccaaggggcgcacgctggacgacgtggtgccgctctgggaagaggccggcatcccgtatccgcgcgactgggacgagagccgcgcgctcgtgttcgagatcccttggcgagactggaccctgcggtacctcctcgccaagccggccgacgtgcccacgtacgtcgcctacggtgtggccgatctcggcattgtcggcaacgacatcctgctcgaacaggagcgggagatgtacgagctgctcgatctcggcgtcgcgcgctgcaagctctgcgtcgccgggcgcgaagaggagcgccgccacgcgccgcgccgcgtggcgaccaaatacccgaagctcgccgaccggtactttcgcagccaggggcaccaggtggagattgtgccgctcgcggggtccatcgagctcgccagcgtgattggcctgacggatcgcatcttcgatctcgtccagaccggcgagacgctccgggccaacgggctcgtggtgttcgacgaggtgctcgacatctccgcgaggctcgtggccaaccgatccagctaccggatgaagcaccgagaaatctcggcctgcattgagcgcctggaggcggccgtcgcgaggaggaacgcgtatgcgccttga

SEQ ID NO: 1020 - DNA, 642 bp, Artificial
  Substituion in SEQ ID NO 1005
atgttgaccgtggcgatggccaaggggcgcacgctggacgacgtggtgccgctctgggaagaggccggcatcccgtatccgcgcgactgggacgagagccgcgcgctcgtgttcgagatcccttggcgagactggaccctgcggtacctcctcgccaagccggccgacgtgcccacgtacgtcgcctacggtgtggccgatctcggcattgtcggcaacgacatcctgctcgaacaggagcgggagatgtacgagctgctcgatctcggcgtcgcgcgctgcaagctctgcgtcgccgggcgcgaagaggagcgccgccacgcgccgcgccgcgtggcgaccaaatacccgaagctcgccgaccggtactttcgcagccaggggcaccaggtggagattgtgccgctcgcggggtccatcgagctcgccagcgtgattggcctgacggatcgcatcttcgatctcgtccagaccggcgagacgctccgggccaacgggctcgtggtgttcgacgaggtgctcgacatctccgcgaggctcgtggccaacaaatccagctaccggatgaagcaccgagaaatctcggcctgcctggagcgcctggaggcggccgtcgcgaggaggaacgcgtatgcgccttga

SEQ ID NO: 1021 - protein, 398 aa, Alicyclobacillus acidocaldarius
MYDIYGEAALPADVRERLRITRDLAQAFHERAPEHDRAGDFPFENIEDLKASGYVRWTVPVEYGGLGLSLEEMLMHQEVLAKGDGSTALAIGWHVGILLHLRETGAFPDELFRMVCESVVKEGALINSCATEPATGSPSRGGKPETTAVKVPGGYRITGRKTFSTLSPALTWIMVTATVADEDVVGQFLVRKEDVEIVETWDTLGMRATGSHDIVLKDVFVPEERVIVIQRPGVQAERRPDGSGWLLHIPACYLGIALAARDFALEYAATYRPNTLPHPIAEVPHVEQKLGEMELKLLAARTLLYDLARRFDAASPEERVKLQPQFGAVKTLATNAANQVVDLAMRVVGGRSLSRALPLERYYRDVRAGLHNPPMDDVVYRNLAKAALARRAAGQAGR

SEQ ID NO: 1022 - DNA, 1197 bp, Alicyclobacillus acidocaldarius
atgtacgacatctatggagaagccgcactgcccgcggacgtgcgcgagcgcctgcgcatcacgcgcgatctcgcccaagccttccacgagcgcgcgcccgagcacgatcgcgcgggcgactttccgtttgagaacatcgaggatttgaaggcgtcgggttacgtgcgctggacggtgcccgtggaatacggggggctcggcctaagcctcgaggagatgctcatgcatcaggaggtgctggcgaaaggcgacggatcgaccgcgctcgcgattggctggcacgtgggcattctgcttcacctgcgcgagacgggggcgttcccggatgagctgtttcgcatggtgtgcgagtccgtcgtgaaggagggcgcgctcatcaacagctgcgccacggagcccgccacggggagcccgagccgcggcggcaagccggagaccaccgccgtgaaagtgcccggcgggtatcggatcacgggccgcaagacattcagcacgctctcgcctgcgctcacctggatcatggtgaccgccaccgtggcggacgaggacgtggtggggcagtttctcgttcgaaaagaggacgtcgagatcgtcgagacgtgggacacgctcggcatgcgcgccaccggcagccacgacattgtgctgaaggatgtgtttgtgccggaggagcgggtgattgtcatccagcgcccgggcgtgcaggccgagcgacggccggacgggagcggttggctgctccacattccggcgtgttatctcggcatcgccctcgcggcgcgcgactttgcgctggagtacgccgcgacgtaccggcccaacacgttgccgcatcccatcgcggaggttccgcacgtcgagcagaaactcggcgagatggagctgaagctgctcgccgcccgcacgctcctgtacgatctcgcccgccgcttcgacgccgcctcgccggaggaacgcgtcaagctgcaaccccagttcggcgcggtgaagacgctcgcgacgaatgccgccaatcaggtggtggatctcgccatgcgggtcgtcggcggccgcagcctgtcgcgcgccctgcccctcgagcggtactaccgcgacgtccgcgccggcctgcacaatccgccgatggacgacgtggtctaccgcaacctggcgaaggccgcgctcgcgcgccgcgccgcggggcaggcggggaggtga

SEQ ID NO: 1023 - protein, 367 aa, Symbiobacterium thermophilum IAM 14863
RRFVALAGELADRFAGRAALHDRENSFPFENFAELRASGYVRLTVPVEWGGEGANLTETLLAQERLAQGDGATALGIGWHLAVVGKLAETRAWPPAATARIFREVAGRGALINSAASEVETGSPSRGGRPTTTARRAPGGWLLTGRKSFTSLAPVLDYAVVSASFEGSDGGGWFLVQTGSPGVTVVETWDALGMRATGSHDLVLEDVFVEDGDLLETFGRGNTCQVGTGDGAGWALHIPAVYLGIARAAHGFAVEYARTRRPNSLPGPIADQPHIQALLGQNEIDLLAARSALYTVADRWDAEPERRGELVPLLGAAKVLAVNLALQIVDRAMRVAGIAGLFRQLPLERLYRDVRAGLHNPPMEDAV

SEQ ID NO: 1024 - protein, 360 aa, Oceanobacillus iheyensis HTE831
KRIQLLKNTVAPFNERAQKHDKDVSFPFENYKDLQSIGYPSLTIPKEYGGAGITLDELLTYQEIIAQADGSTALSIGWHMGIMKYLGENKIWNEDVYSTVANDVIQNGALLNNAATEPATGSPTRGGKPETHAIKQGNKWIMNGRKTFTTLSPILTYFVVSATIDETGEVGNFLIKRDRPGVNVEETWDSIAMRGSGSHDLVLENVHLDEENLVEILSNKKRKPAGWLLHIPACYLGIAQAAQKEAVQFAMNYSPNSIEGTISDLPNVKQKMGDLELLLMESKHFLHSIAQQWDNGDENIRVAMGPELGAAKLSVTNKAVHAVDLAMRIVGAKSLSEKNNLQRYYRDVRAGLHNPPMDDM

SEQ ID NO: 1025 - protein, 364 aa, Bacillus sp. NRRL B-14911
KAAGEADKYEQMKELSAIFKERSRSKENRGSFPHRNILDLKASGYTSLTVPADRGGKGISLLEMIRLQEKLAEGDGSTALAIGWHMGITKNLGEKRKWDDELFSFLCREILDGKLINSAATERQTGSPTRGGRPQTTAVLKGGNWVISGRKTFTTMAPALDYFIVSAFIPSEDKTGNFLVPREAEGLSIEETWDSVSMRGTGSHDLVLDEVSIDKTFLAEILGQDKKANGWLLHIPAVYLGIAQAAQDYAAGFAKSYSPNSIQGTISDIPSVQQKIGEIELELMRAREFLYAAADRWDRAAENERESMQPLLGAVKLAVTNAALTVADLAIRVVGARSLSEQNPLQQYYLDIRAGLHNPPMDDM

SEQ ID NO: 1026 - protein, 351 aa, Bacillus subtilis subsp. subtilis str. 168
IADEFQQTAAEDDEQGRFPAEKIQKLRDAGYTALTLPASHGGGGISVYDMLLFQERLARGDAPTALSIGWHLSVIGELGEGNSWDEDVFAFVAKEVQNGAVINRAATEAKTGSPTRGGRPGTHAVKKDGKWAVNGRKTFTTMSQALDYFLVTAWIEDKQTTGVFLIHKDDPGLSIEETWDMMAMRATGSHDLVLNEVMLDENKLVELLQGPRGAKPNGWLLHIPAIYLGVAQAARDYAVQFASEYSPNSLNGPIKNVPAVQQRTGEMELELLNARHFLFHIAQLYDDPVRRPHLTSELGAAKHIVTNAALSVVDKAMRIVGAKSLERTNPLQRYYRDVRAGLHNPPMDDAV

SEQ ID NO: 1027 - protein, 346 aa, Bacillus cereus subsp. cytotoxis NVH 391-98
FQERECELRELGSFPFENINELKDIGYTTLTLPKDCGGQEISLYDFVLYQEKIAEGDGATALSIGWHLGIVKELTENQSWKPDMFAWFCEEVKKGALFNRAATERKTGSPTRGGRPETLAVKKGEKWIINGRKTFTTMAPMLDYFIISASIEGREEIGEFVVPRAQKGVSIEETWDSVAMRGTASHDLVLRNVEISDKYFTDIKGSQSKPKGVGWLLHIPACYLGIAQAARNYALRFAESYQPNSLKHPISSLPNIRRLVGELELELMQARMFLYQIAKKYDEVDDKQSLQAELAAAKYIATNAAISVVDKAMRIVGAKSLSEKNPLHRYYLNVRAGLHNPPMDDV

SEQ ID NO: 1028 - protein, 398 aa, Artificial
  Substituion in SEQ ID NO 1021
MYDIYGEAALPADVRERLRITRDLAQAFHERAPEHDRAGDFPFENIEDLKASGYVRWTVPVEYGGLGLSLEEMLMHQEVLAKGDGSTALAIGWHVGILLHLRETGAFPDELFRMVCESVVKEGALINSCATEPATGSPSRGGKPETTAVKVPGGYRITGRKTFSTLSPALTWIMVTATVADEDVVGQFLVRKEDVEIVETWDTLGMRATGSHDIVLKDVFVPEERVIVIQRPGVQAERRPDGSGWLLHIPACYLGIALAARDFALEYAATYRPNTLPHPIAEVPHVEQKLGEMELKLLAARTLLYDLARRFDAASPEERIKLQPQFGAVKTLATNAANQVVDLAMRVVGGRSLSRALPLERYYRDVRAGLHNPPMDDVVYRNLAKAALARRAAGQAGR

SEQ ID NO: 1029 - protein, 398 aa, Artificial
  Substituion in SEQ ID NO 1021
MYDIYGEAALPADVRERLRITRDLAQAFHERAPEHDRAGDFPFENIEDLKASGYVRWTVPVEYGGLGLSLEEMLMHQEVLAKGDGSTALAIGWHVGILLHLRETGAFPDELFRMVCESVVKEGALINSCATEPATGSPSRGGKPETTAVKVPGGYRITGRKTFSTLSPALTWIMVTATVADEDVVGQFLVRKEDVEIVETWDTLGMRATGSHDIVLKDVFVPEERVIVIQRPGVQAERRPDGSGWLLHIPACYLGIALAARDFALEYAATYRPNTLPHPIAEVPHVEQKLGEMELKLLAARTLLYDLARRFDAASPEERVKLQPQFGAVKTIATNAANQVVDLAMRVVGGRSLSRALPLERYYRDVRAGLHNPPMDDVVYRNLAKAALARRAAGQAGR

SEQ ID NO: 1030 - protein, 398 aa, Artificial
  Substituion in SEQ ID NO 1021
MYDIYGEAALPADVRERLRITRDLAQAFHERAPEHDRAGDFPFENIEDLKASGYVRWTVPVEYGGLGLSLEEMLMHQEVLAKGDGSTALAIGWHVGILLHLRETGAFPDELFRMVCESVVKEGALINSCATEPATGSPSRGGKPETTAVKVPGGYRITGRKTFSTLSPALTWIMVTATVADEDVVGQFLVRKEDVEIVETWDTLGMRATGSHDIVLKDVFVPEERVIVIQRPGVQAERRPDGSGWLLHIPACYLGIALAARDFALEYAATYRPNTLPHPIAEVPHVEQKLGEMELKLLAARTLLYDLARRFDAASPEERVKLQPQFGAVKTLATNAANQVVDLAMRVVGGRSLSRALPLERYYRDVRAGLHNPPMDDVVYRNLAKAALARRAAGNAGR

SEQ ID NO: 1031 - protein, 398 aa, Artificial
  Substituion in SEQ ID NO 1021
MYDIYGEAALPADVRERLRITRDLAQAFHERAPEHDRAGDFPFENIEDLKASGYVRWTVPVEYGGLGLSLEEMLMHQEVLAKGDGSTALAIGWHVGIILHLRETGAFPDELFRMVCESVVKEGALINSCATEPATGSPSRGGKPETTAVKVPGGYRITGRKTFSTLSPALTWIMVTATVADEDVVGQFLVRKEDVEIVETWDTLGMRATGSHDIVLKDVFVPEERVIVIQRPGVQAERRPDGSGWLLHIPACYLGIALAARDFALEYAATYRPNTLPHPIAEVPHVEQKLGEMELKLLAARTLLYDLARRFDAASPEERVKLQPQFGAVKTLATNAANQVVDLAMRVVGGRSLSRALPLERYYRDVRAGLHNPPMDDVVYRNLAKAALARRAAGQAGR

SEQ ID NO: 1032 - protein, 398 aa, Artificial
  Substituion in SEQ ID NO 1021
MYDIYGEAALPADVRERLRITRDLAQAFHERAPEHDRAGDFPFENIEDLKASGYVRWTVPVEYGGLGLSLEEMLMHQEVLAKGDGSTALAIGWHVGILLHLRETGAFPDELFRMVCESVVKEGALINSCATEPATGSPSRGGKPETTAVKVPGGYRITGRKTFSTLSPALTWIMVTATVADEDVVGQFLVRKEDVEIVETWDTLGMRATGSHDIVLKDVFVPEERVIVIQRPGVQAERRPDGSGWLLHIPACYLGIALAARDFALEYAATYRPNTLPHPIAEVPHVEQKLGEMELKLLAARTLLYDLARRFDAASPEERVKLQPNFGAVKTLATNAANQVVDLAMRVVGGRSLSRALPLERYYRDVRAGLHNPPMDDVVYRNLAKAALARRAAGQAGR

SEQ ID NO: 1033 - DNA, 1197 bp, Artificial
  Substituion in SEQ ID NO 1022
atgtacgacatctatggagaagccgcactgcccgcggacgtgcgcgagcgcctgcgcatcacgcgcgatctcgcccaagccttccacgagcgcgcgcccgagcacgatcgcgcgggcgactttccgtttgagaacatcgaggatttgaaggcgtcgggttacgtgcgctggacggtgcccgtggaatacggggggctcggcctaagcctcgaggagatgctcatgcatcaggaggtgctggcgaaaggcgacggatcgaccgcgctcgcgattggctggcacgtgggcattctgcttcacctgcgcgagacgggggcgttcccggatgagctgtttcgcatggtgtgcgagtccgtcgtgaaggagggcgcgctcatcaacagctgcgccacggagcccgccacggggagcccgagccgcggcggcaagccggagaccaccgccgtgaaagtgcccggcgggtatcggatcacgggccgcaagacattcagcacgctctcgcctgcgctcacctggatcatggtgaccgccaccgtggcggacgaggacgtggtggggcagtttctcgttcgaaaagaggacgtcgagatcgtcgagacgtgggacacgctcggcatgcgcgccaccggcagccacgacattgtgctgaaggatgtgtttgtgccggaggagcgggtgattgtcatccagcgcccgggcgtgcaggccgagcgacggccggacgggagcggttggctgctccacattccggcgtgttatctcggcatcgccctcgcggcgcgcgactttgcgctggagtacgccgcgacgtaccggcccaacacgttgccgcatcccatcgcggaggttccgcacgtcgagcagaaactcggcgagatggagctgaagctgctcgccgcccgcacgctcctgtacgatctcgcccgccgcttcgacgccgcctcgccggaggaacgcattaagctgcaaccccagttcggcgcggtgaagacgctcgcgacgaatgccgccaatcaggtggtggatctcgccatgcgggtcgtcggcggccgcagcctgtcgcgcgccctgcccctcgagcggtactaccgcgacgtccgcgccggcctgcacaatccgccgatggacgacgtggtctaccgcaacctggcgaaggccgcgctcgcgcgccgcgccgcggggcaggcggggaggtga

SEQ ID NO: 1034 - DNA, 1197 bp, Artificial
  Substituion in SEQ ID NO 1022
atgtacgacatctatggagaagccgcactgcccgcggacgtgcgcgagcgcctgcgcatcacgcgcgatctcgcccaagccttccacgagcgcgcgcccgagcacgatcgcgcgggcgactttccgtttgagaacatcgaggatttgaaggcgtcgggttacgtgcgctggacggtgcccgtggaatacggggggctcggcctaagcctcgaggagatgctcatgcatcaggaggtgctggcgaaaggcgacggatcgaccgcgctcgcgattggctggcacgtgggcattctgcttcacctgcgcgagacgggggcgttcccggatgagctgtttcgcatggtgtgcgagtccgtcgtgaaggagggcgcgctcatcaacagctgcgccacggagcccgccacggggagcccgagccgcggcggcaagccggagaccaccgccgtgaaagtgcccggcgggtatcggatcacgggccgcaagacattcagcacgctctcgcctgcgctcacctggatcatggtgaccgccaccgtggcggacgaggacgtggtggggcagtttctcgttcgaaaagaggacgtcgagatcgtcgagacgtgggacacgctcggcatgcgcgccaccggcagccacgacattgtgctgaaggatgtgtttgtgccggaggagcgggtgattgtcatccagcgcccgggcgtgcaggccgagcgacggccggacgggagcggttggctgctccacattccggcgtgttatctcggcatcgccctcgcggcgcgcgactttgcgctggagtacgccgcgacgtaccggcccaacacgttgccgcatcccatcgcggaggttccgcacgtcgagcagaaactcggcgagatggagctgaagctgctcgccgcccgcacgctcctgtacgatctcgcccgccgcttcgacgccgcctcgccggaggaacgcgtcaagctgcaaccccagttcggcgcggtgaagacgattgcgacgaatgccgccaatcaggtggtggatctcgccatgcgggtcgtcggcggccgcagcctgtcgcgcgccctgcccctcgagcggtactaccgcgacgtccgcgccggcctgcacaatccgccgatggacgacgtggtctaccgcaacctggcgaaggccgcgctcgcgcgccgcgccgcggggcaggcggggaggtga

SEQ ID NO: 1035 - DNA, 1197 bp, Artificial
  Substituion in SEQ ID NO 1022
atgtacgacatctatggagaagccgcactgcccgcggacgtgcgcgagcgcctgcgcatcacgcgcgatctcgcccaagccttccacgagcgcgcgcccgagcacgatcgcgcgggcgactttccgtttgagaacatcgaggatttgaaggcgtcgggttacgtgcgctggacggtgcccgtggaatacggggggctcggcctaagcctcgaggagatgctcatgcatcaggaggtgctggcgaaaggcgacggatcgaccgcgctcgcgattggctggcacgtgggcattctgcttcacctgcgcgagacgggggcgttcccggatgagctgtttcgcatggtgtgcgagtccgtcgtgaaggagggcgcgctcatcaacagctgcgccacggagcccgccacggggagcccgagccgcggcggcaagccggagaccaccgccgtgaaagtgcccggcgggtatcggatcacgggccgcaagacattcagcacgctctcgcctgcgctcacctggatcatggtgaccgccaccgtggcggacgaggacgtggtggggcagtttctcgttcgaaaagaggacgtcgagatcgtcgagacgtgggacacgctcggcatgcgcgccaccggcagccacgacattgtgctgaaggatgtgtttgtgccggaggagcgggtgattgtcatccagcgcccgggcgtgcaggccgagcgacggccggacgggagcggttggctgctccacattccggcgtgttatctcggcatcgccctcgcggcgcgcgactttgcgctggagtacgccgcgacgtaccggcccaacacgttgccgcatcccatcgcggaggttccgcacgtcgagcagaaactcggcgagatggagctgaagctgctcgccgcccgcacgctcctgtacgatctcgcccgccgcttcgacgccgcctcgccggaggaacgcgtcaagctgcaaccccagttcggcgcggtgaagacgctcgcgacgaatgccgccaatcaggtggtggatctcgccatgcgggtcgtcggcggccgcagcctgtcgcgcgccctgcccctcgagcggtactaccgcgacgtccgcgccggcctgcacaatccgccgatggacgacgtggtctaccgcaacctggcgaaggccgcgctcgcgcgccgcgccgcggggaatgcggggaggtga

SEQ ID NO: 1036 - DNA, 1197 bp, Artificial
  Substituion in SEQ ID NO 1022
atgtacgacatctatggagaagccgcactgcccgcggacgtgcgcgagcgcctgcgcatcacgcgcgatctcgcccaagccttccacgagcgcgcgcccgagcacgatcgcgcgggcgactttccgtttgagaacatcgaggatttgaaggcgtcgggttacgtgcgctggacggtgcccgtggaatacggggggctcggcctaagcctcgaggagatgctcatgcatcaggaggtgctggcgaaaggcgacggatcgaccgcgctcgcgattggctggcacgtgggcattattcttcacctgcgcgagacgggggcgttcccggatgagctgtttcgcatggtgtgcgagtccgtcgtgaaggagggcgcgctcatcaacagctgcgccacggagcccgccacggggagcccgagccgcggcggcaagccggagaccaccgccgtgaaagtgcccggcgggtatcggatcacgggccgcaagacattcagcacgctctcgcctgcgctcacctggatcatggtgaccgccaccgtggcggacgaggacgtggtggggcagtttctcgttcgaaaagaggacgtcgagatcgtcgagacgtgggacacgctcggcatgcgcgccaccggcagccacgacattgtgctgaaggatgtgtttgtgccggaggagcgggtgattgtcatccagcgcccgggcgtgcaggccgagcgacggccggacgggagcggttggctgctccacattccggcgtgttatctcggcatcgccctcgcggcgcgcgactttgcgctggagtacgccgcgacgtaccggcccaacacgttgccgcatcccatcgcggaggttccgcacgtcgagcagaaactcggcgagatggagctgaagctgctcgccgcccgcacgctcctgtacgatctcgcccgccgcttcgacgccgcctcgccggaggaacgcgtcaagctgcaaccccagttcggcgcggtgaagacgctcgcgacgaatgccgccaatcaggtggtggatctcgccatgcgggtcgtcggcggccgcagcctgtcgcgcgccctgcccctcgagcggtactaccgcgacgtccgcgccggcctgcacaatccgccgatggacgacgtggtctaccgcaacctggcgaaggccgcgctcgcgcgccgcgccgcggggcaggcggggaggtga

SEQ ID NO: 1037 - DNA, 1197 bp, Artificial
  Substituion in SEQ ID NO 1022
atgtacgacatctatggagaagccgcactgcccgcggacgtgcgcgagcgcctgcgcatcacgcgcgatctcgcccaagccttccacgagcgcgcgcccgagcacgatcgcgcgggcgactttccgtttgagaacatcgaggatttgaaggcgtcgggttacgtgcgctggacggtgcccgtggaatacggggggctcggcctaagcctcgaggagatgctcatgcatcaggaggtgctggcgaaaggcgacggatcgaccgcgctcgcgattggctggcacgtgggcattctgcttcacctgcgcgagacgggggcgttcccggatgagctgtttcgcatggtgtgcgagtccgtcgtgaaggagggcgcgctcatcaacagctgcgccacggagcccgccacggggagcccgagccgcggcggcaagccggagaccaccgccgtgaaagtgcccggcgggtatcggatcacgggccgcaagacattcagcacgctctcgcctgcgctcacctggatcatggtgaccgccaccgtggcggacgaggacgtggtggggcagtttctcgttcgaaaagaggacgtcgagatcgtcgagacgtgggacacgctcggcatgcgcgccaccggcagccacgacattgtgctgaaggatgtgtttgtgccggaggagcgggtgattgtcatccagcgcccgggcgtgcaggccgagcgacggccggacgggagcggttggctgctccacattccggcgtgttatctcggcatcgccctcgcggcgcgcgactttgcgctggagtacgccgcgacgtaccggcccaacacgttgccgcatcccatcgcggaggttccgcacgtcgagcagaaactcggcgagatggagctgaagctgctcgccgcccgcacgctcctgtacgatctcgcccgccgcttcgacgccgcctcgccggaggaacgcgtcaagctgcaacccaatttcggcgcggtgaagacgctcgcgacgaatgccgccaatcaggtggtggatctcgccatgcgggtcgtcggcggccgcagcctgtcgcgcgccctgcccctcgagcggtactaccgcgacgtccgcgccggcctgcacaatccgccgatggacgacgtggtctaccgcaacctggcgaaggccgcgctcgcgcgccgcgccgcggggcaggcggggaggtga

SEQ ID NO: 1038 - protein, 491 aa, Alicyclobacillus acidocaldarius
MSSTTSVKYAQWNKLYLGGEWRSGTSSRTVTVRNPYNQEVLAEFPLASVEDIDQAYRKAQAAQQGWAEESAFTRAEVMERAASILAQRKDEIVRYLVEETGSSQLKASIEVDASIGDIKLAAEYAHKMTAVILPSAIPGKENRVYRTPVGVVGAITPWNWPFYLSIRVVAPALATGNAIVLKADSQTPITGGLLVADLFEQAGLPPGLLSVVVADLDEIGDAMVEHPVPRVISFTGSTAAGRHIAEVAARSLRKVALELGGNNVFIVLDDADVDQAVAAAAFGKYLHQGQICIATNRMIVHRKVYDEFVEKFMAATEKVKVGDPADPETVICPLINERQAKRIMGLIDESLKMGARLVLEGKLEGLLMYPYILADVTNDMPIAKNEIFGPVAAILPVDSEEEAVNIANESDYGLSGAVFTGDLERGIRVAQRIVTGMIHVNDQTVNVESNVPFGGEKASGIGRYCGEWGIEEFTTLKWISVQKEPRVYPFS

SEQ ID NO: 1039 - DNA, 1476 bp, Alicyclobacillus acidocaldarius
gtgtcgagcacaacatcggtgaagtacgctcaatggaacaaattgtatcttgggggagagtggaggtctgggacgagcagcagaacggtgacggttcgcaatccatacaatcaggaggtcctcgcggaatttccgctggcatcggtggaagacatcgatcaggcctatcgaaaggcccaggccgcacagcaaggatgggctgaggagagtgcgttcactcgcgccgaggtgatggagcgcgcagctagtattctcgcgcagcggaaggatgaaatcgtccggtacttggtcgaggaaacgggaagttctcaactcaaggcgagcatcgaagtggatgcttccatcggcgacatcaagttggccgccgagtatgcgcacaaaatgacggcggtgatcctcccttccgcgattcccggcaaggagaatcgcgtgtatcgcactcccgtcggagtcgtgggcgccatcacaccgtggaattggccgttttatctgagtatccgcgtggtggcgccagcgcttgcgacggggaacgccatcgtcctcaaggcagattctcagacgcccatcaccggcggactccttgtcgcggatctgtttgagcaggcagggcttccaccagggctcttgagtgtggtggtggccgatctcgacgagatcggagacgcgatggtcgaacatccggttccccgggtgatctcgttcacagggtccacagcggcaggtcggcatatcgctgaggtcgcggcgcgatcgctgcgcaaggtggcgctcgaactcggcgggaacaacgtgttcattgtgctcgacgatgcggacgtcgaccaggcggttgccgcggcggcgttcgggaaatatcttcaccaaggccagatctgcatcgcaacaaaccgcatgattgtccatcgcaaggtgtacgacgagtttgtcgagaagttcatggcagcgaccgaaaaggtgaaggtcggcgatccggcagaccccgagacggtgatttgcccgctcatcaacgagcgccaggcaaaacggatcatggggctcatcgacgagagcttgaagatgggggcacgcctggtcttggagggaaagctcgaagggctgcttatgtatccatacatcctggcggatgtgactaacgacatgcccatcgcgaaaaacgagatcttcggcccggtcgcggccattctgcccgtggatagcgaggaggaggccgtgaacatcgcaaacgagtcggactatggactgtccggggcagtgtttacgggagatcttgagcgcggcatccgagtcgcccagcgcattgtcacagggatgattcacgtcaatgaccaaacggtcaatgtggagtccaatgttccatttggtggagaaaaggcttccggcatcggccgttattgtggagagtggggcattgaggagttcaccacgttgaagtggatttccgtgcagaaagagccgagagtgtatccgttttcgtaa

SEQ ID NO: 1040 - protein, 481 aa, Oceanobacillus iheyensis HTE831
YENLNKNFISGEWRDGQGETTYEVKNPYNDEVLQEIKMASKEDIDEAYKSAEQAKKKWAKFNPFERSSIMEKAVQIIDARREEFVNHLIREGGSSHLKANVEIDFVIAITREAASFPLRMSGEIVPSLIPGKENRIYRSPLGVVGVIGPFNFPMYLAMRSVAPALAVGNGVVLKPDDQTAVTGGILLAKVFEEAGLPKGVFNVVVPNIEDIGDAFVEHPIPRLISFTGSTPVGRHIGEICGRNIKKVALELGGNNPLVVLEDAKVENAVNSALFGKFMHNGQICMAINRIIVHKDIYEEFVEKFVEKAKKIKVGNPSEKDNLIGPLINRQAIDRILEQIESAKEQGAEVVLEGKVEGNVMHPYILTGSNDVATAQNEMFGPVATIISAESDEEAIRIANDTPFGLSGAVHAGSPERGVEVAKQITSGMVHVNDQSVNDEPLIAFGGEKASGLGRFGGKWSLEEFTTVQWISVQTEERENPF

SEQ ID NO: 1041 - protein, 481 aa, Bacillus halodurans C-125
AIYTRQFLAGEWIEGASTQTITNYNPYTGEKIHEIKGASLDDLDQAYRAAKNAQKEWEQTLPAQKQEVLEKAAALLAERKDEVIERLVNEAGSSIIKASIEWGATLQTIKVAATFPLRMEGKILPSNIPGKENRIYRSAKGVIGVISPFNFPLVLAMRSVAPALATGNAVVLKCSSDAPITSGLLIAELFEEAGLPKGVLNVVVGKAAEIGDAFVTHPIPKLISFTGSTEVGRHIAQLAARELKETALELGGNNVMIVLDDADIEKAAEKAAVGKFLHQGQICMALNRIIVDASIYDSFVEVFKEKVSQLQTGNPAEPATLIGPLINYKQIGRIQQLVKESVAQGAVKVLEGHVQGNLMSPTILSEVTNDMPVAKEEIFGPIAPIIKAKDEAEAIAIANDSPYGLSGSIFTGSLHRGVQVAKQIDTGMIHVNDQPVNEEAHISFGGEKDSGIGRFGGEWVLDKFTTVKWISIQEKERVYPF

SEQ ID NO: 1042 - protein, 478 aa, Bacillus halodurans C-125
NKQYIDGEWRDGKSPRVLRDRNPYNQEVLAEFQIATDSDVDAAYHAALKAQNEWATVNPYRKREILERAVTYIEEHEEEIVAIIIDELGGTRLKAAFEIGLVKNMIKEASTFPLRMEGKILPSTENGKENRLYRVPAGVVGVISPFNFPFFLSVKSVAPALGAGNGVVLKPHEETPITGGTLIAKIFEEAGVPKGLLNVVVTEIDEIGNAFVEHPIPRIISFTGSTNVGSHIGQLAVKHFKKPLLELGGNSAFLIFADADLDYAVQAATFSRFTHQGQICMSANRIFVQRDVYDEFVERYVTKVASLKVGDPRDPETVIGPVMNSRQAETLKQAIESGIAAGAKPVLHGAISGNMVEPTILIDASPEMAIAQEELFGPVVCVIPFDTEEEAVEMANDTKYGLSGAIHTANVERGVEIAKRIQTGMIHVNDITINDEPIVAFGGEKHSGLGRLNGEWSLEEFTTLKWVSVHYSQRVFPY

SEQ ID NO: 1043 - protein, 483 aa, Bacillus amyloliquefaciens FZB42
QYEELNKQFIGGRWRDGSSRNVLENRNPYTQKVITSFQKATSDDVDAAYRAAALAKQEWDKVNPFKKRAILEKAVSFIEEHEEAIIYLIMEELGGTRLKAEFEIGLVKNMIKEAATFPVRMEGKILPSTIDGKENRLYRIPAGVVGVISPFNFPFFLSMKSVAPALGAGNGVVLKPHEETPICGGTLIAKIFEAAGVPDGLLNVIVTDIGEIGDSFVEHPVPRIISFTGSTGVGSYIGQLAVKHFKKPLLELGGNSALIVLEDADLEYAVNAAVFSRFTHQGQICMSANRVLVHTSVYDKFTELYEAKVSSLKVGDPMDPDTVIGPLINERQAEGLRRSVEKAIEEGAVPVLSGRFSGTVAEPVILKDVKPEMSIAKEELFGPAVCIMTFETEDEAVSIANATPFGLSGAVHTANVERGVEFAKRIETGMIHVNDTTINDEPNVAFGGEKQSGLGRLNGEWSLEEFTTLKWISVQHEKRQFPY

SEQ ID NO: 1044 - protein, 483 aa, Bacillus subtilis subsp. subtilis str. 168
QYEELNKQFIGGKWQEGSSPNVLENKNPYTQKTFTTFRKATADDVDEAYRAAALAKKKWDAVNPFEKRTILEKAVTYIEENEEAIIYLIMEELGGTRLKAAFEIGLVKNIIKEAATFPIRMEGKILPSTIDGKENRLYRVPAGVVGVISPFNFPFFLSMKSVAPALGAGNGVVLKPHEETPICGGTLIAKIFENAGIPAGLLNVVVTDIAEIGDSFVEHPVPRIISFTGSTKVGSYIGQLAMKHFKKPLLELGGNSAFIVLEDADIEYAVNAAVFSRFTHQGQICMSANRVLVHSSIYDKFLELYQAKVESLKVGDPMDPDTIIGPLINSRQTDGLMKTVEQAIEEGAVPVKLGGFNGTIVEPTILKDVKPFMSIAKEELFGPVVSFMKFDSEDEAVDIANETPFGLSGAVHTSNLERGVAFAKRIETGMIHVNDTTINDEPNVAFGGEKQSGLGRLNGEWSLEEFTTLKWISVQHEKRSFPY

SEQ ID NO: 1045 - protein, 491 aa, Artificial
  Substituion in SEQ ID NO 1038
MSSTTSVKYAQWNKLYLGGEWRSGTSSRTVTVRNPYNQEVLAEFPLASVEDIDQAYRKAQAAQQGWAEDSAFTRAEVMERAASILAQRKDEIVRYLVEETGSSQLKASIEVDASIGDIKLAAEYAHKMTAVILPSAIPGKENRVYRTPVGVVGAITPWNWPFYLSIRVVAPALATGNAIVLKADSQTPITGGLLVADLFEQAGLPPGLLSVVVADLDEIGDAMVEHPVPRVISFTGSTAAGRHIAEVAARSLRKVALELGGNNVFIVLDDADVDQAVAAAAFGKYLHQGQICIATNRMIVHRKVYDEFVEKFMAATEKVKVGDPADPETVICPLINERQAKRIMGLIDESLKMGARLVLEGKLEGLLMYPYILADVTNDMPIAKNEIFGPVAAILPVDSEEEAVNIANESDYGLSGAVFTGDLERGIRVAQRIVTGMIHVNDQTVNVESNVPFGGEKASGIGRYCGEWGIEEFTTLKWISVQKEPRVYPFS

SEQ ID NO: 1046 - protein, 491 aa, Artificial
  Substituion in SEQ ID NO 1038
MSSTTSVKYAQWNKLYLGGEWRSGTSSKTVTVRNPYNQEVLAEFPLASVEDIDQAYRKAQAAQQGWAEESAFTRAEVMERAASILAQRKDEIVRYLVEETGSSQLKASIEVDASIGDIKLAAEYAHKMTAVILPSAIPGKENRVYRTPVGVVGAITPWNWPFYLSIRVVAPALATGNAIVLKADSQTPITGGLLVADLFEQAGLPPGLLSVVVADLDEIGDAMVEHPVPRVISFTGSTAAGRHIAEVAARSLRKVALELGGNNVFIVLDDADVDQAVAAAAFGKYLHQGQICIATNRMIVHRKVYDEFVEKFMAATEKVKVGDPADPETVICPLINERQAKRIMGLIDESLKMGARLVLEGKLEGLLMYPYILADVTNDMPIAKNEIFGPVAAILPVDSEEEAVNIANESDYGLSGAVFTGDLERGIRVAQRIVTGMIHVNDQTVNVESNVPFGGEKASGIGRYCGEWGIEEFTTLKWISVQKEPRVYPFS

SEQ ID NO: 1047 - protein, 491 aa, Artificial
  Substituion in SEQ ID NO 1038
MSSTTSVKYAQWNKLYLGGEWRSGTSSRTVTVRNPYNQEVLADFPLASVEDIDQAYRKAQAAQQGWAEESAFTRAEVMERAASILAQRKDEIVRYLVEETGSSQLKASIEVDASIGDIKLAAEYAHKMTAVILPSAIPGKENRVYRTPVGVVGAITPWNWPFYLSIRVVAPALATGNAIVLKADSQTPITGGLLVADLFEQAGLPPGLLSVVVADLDEIGDAMVEHPVPRVISFTGSTAAGRHIAEVAARSLRKVALELGGNNVFIVLDDADVDQAVAAAAFGKYLHQGQICIATNRMIVHRKVYDEFVEKFMAATEKVKVGDPADPETVICPLINERQAKRIMGLIDESLKMGARLVLEGKLEGLLMYPYILADVTNDMPIAKNEIFGPVAAILPVDSEEEAVNIANESDYGLSGAVFTGDLERGIRVAQRIVTGMIHVNDQTVNVESNVPFGGEKASGIGRYCGEWGIEEFTTLKWISVQKEPRVYPFS

SEQ ID NO: 1048 - protein, 491 aa, Artificial
  Substituion in SEQ ID NO 1038
MSSTTSVKYAQWNKLYLGGEWRSGTSSRTVTVRNPYNQEVLAEFPLASVEDIDQAYRKAQAAQQGWAEESAFTRAEVMERAASILAQRKDEIVRYLVEETGSSQLKASIEVDASIGDIKLAAEYAHKMTAVILPSAIPGKENRVYRTPVGVVGAITPWNWPFYLSIRVVAPALATGNAIVLKADSQTPITGGLLVADLFEQAGLPPGLLSVVVADLDEIGDAMVEHPVPRVISFTGSTAAGRHIAEVAARSLRKVALELGGNNVFIVLDDADVDQAVAAAAFGKYLHQGQICIATNRMIVHRKVYDEFVEKFMAATEKVKVGDPADPETVICPLINERQAKRIMGLIDESLKMGARLVLEGKLEGLLMYPYILADVTNDMPIAKNEIFGPVAAILPVDSEEEAVNIANESDYGLSGAVFTGDLERGIRVAQRIVTGMIHVNDQTVNVESNVPFGGEKASGIGRYCGEWGIEEFTTLKWISVQKEPRIYPFS

SEQ ID NO: 1049 - protein, 491 aa, Artificial
  Substituion in SEQ ID NO 1038
MSSTTSVKYAQWNKLYLGGEWRSGTSSRTVTVRNPYNQEVLAEFPLASVEDIDQAYRKAQAAQQGWAEESAFTRAEVMERAASILAQRKDEIVRYLVEETGSSQLKASIEVDASIGDIKLAAEYAHKMTAVILPSAIPGKENRVYRTPVGVVGAITPWNWPFYLSIRVVAPALATGNAIVLKADSQTPITGGLLVADLFEQAGLPPGLLSVVVADLDEIGDAMVEHPVPRVISFTGSTAAGRHIAEVAARSLRKVALELGGNNVFIVLDDADVDQAVAAAAFGKYLHQGQICIATNRMIVHRKVYDEFVEKFMAATEKVKVGDPADPETVICPLINERQAKRIMGLIDESLKMGARLVLEGKLEGLLMYPYILADVTNDMPIAKNEIFGPVAAILPVDSEEEAVNIANESDYGLSGAVFTGDIERGIRVAQRIVTGMIHVNDQTVNVESNVPFGGEKASGIGRYCGEWGIEEFTTLKWISVQKEPRVYPFS

SEQ ID NO: 1050 - DNA, 1476 bp, Artificial
  Substituion in SEQ ID NO 1039
gtgtcgagcacaacatcggtgaagtacgctcaatggaacaaattgtatcttgggggagagtggaggtctgggacgagcagcagaacggtgacggttcgcaatccatacaatcaggaggtcctcgcggaatttccgctggcatcggtggaagacatcgatcaggcctatcgaaaggcccaggccgcacagcaaggatgggctgaggatagtgcgttcactcgcgccgaggtgatggagcgcgcagctagtattctcgcgcagcggaaggatgaaatcgtccggtacttggtcgaggaaacgggaagttctcaactcaaggcgagcatcgaagtggatgcttccatcggcgacatcaagttggccgccgagtatgcgcacaaaatgacggcggtgatcctcccttccgcgattcccggcaaggagaatcgcgtgtatcgcactcccgtcggagtcgtgggcgccatcacaccgtggaattggccgttttatctgagtatccgcgtggtggcgccagcgcttgcgacggggaacgccatcgtcctcaaggcagattctcagacgcccatcaccggcggactccttgtcgcggatctgtttgagcaggcagggcttccaccagggctcttgagtgtggtggtggccgatctcgacgagatcggagacgcgatggtcgaacatccggttccccgggtgatctcgttcacagggtccacagcggcaggtcggcatatcgctgaggtcgcggcgcgatcgctgcgcaaggtggcgctcgaactcggcgggaacaacgtgttcattgtgctcgacgatgcggacgtcgaccaggcggttgccgcggcggcgttcgggaaatatcttcaccaaggccagatctgcatcgcaacaaaccgcatgattgtccatcgcaaggtgtacgacgagtttgtcgagaagttcatggcagcgaccgaaaaggtgaaggtcggcgatccggcagaccccgagacggtgatttgcccgctcatcaacgagcgccaggcaaaacggatcatggggctcatcgacgagagcttgaagatgggggcacgcctggtcttggagggaaagctcgaagggctgcttatgtatccatacatcctggcggatgtgactaacgacatgcccatcgcgaaaaacgagatcttcggcccggtcgcggccattctgcccgtggatagcgaggaggaggccgtgaacatcgcaaacgagtcggactatggactgtccggggcagtgtttacgggagatcttgagcgcggcatccgagtcgcccagcgcattgtcacagggatgattcacgtcaatgaccaaacggtcaatgtggagtccaatgttccatttggtggagaaaaggcttccggcatcggccgttattgtggagagtggggcattgaggagttcaccacgttgaagtggatttccgtgcagaaagagccgagagtgtatccgttttcgtaa

SEQ ID NO: 1051 - DNA, 1476 bp, Artificial
  Substituion in SEQ ID NO 1039
gtgtcgagcacaacatcggtgaagtacgctcaatggaacaaattgtatcttgggggagagtggaggtctgggacgagcagcaaaacggtgacggttcgcaatccatacaatcaggaggtcctcgcggaatttccgctggcatcggtggaagacatcgatcaggcctatcgaaaggcccaggccgcacagcaaggatgggctgaggagagtgcgttcactcgcgccgaggtgatggagcgcgcagctagtattctcgcgcagcggaaggatgaaatcgtccggtacttggtcgaggaaacgggaagttctcaactcaaggcgagcatcgaagtggatgcttccatcggcgacatcaagttggccgccgagtatgcgcacaaaatgacggcggtgatcctcccttccgcgattcccggcaaggagaatcgcgtgtatcgcactcccgtcggagtcgtgggcgccatcacaccgtggaattggccgttttatctgagtatccgcgtggtggcgccagcgcttgcgacggggaacgccatcgtcctcaaggcagattctcagacgcccatcaccggcggactccttgtcgcggatctgtttgagcaggcagggcttccaccagggctcttgagtgtggtggtggccgatctcgacgagatcggagacgcgatggtcgaacatccggttccccgggtgatctcgttcacagggtccacagcggcaggtcggcatatcgctgaggtcgcggcgcgatcgctgcgcaaggtggcgctcgaactcggcgggaacaacgtgttcattgtgctcgacgatgcggacgtcgaccaggcggttgccgcggcggcgttcgggaaatatcttcaccaaggccagatctgcatcgcaacaaaccgcatgattgtccatcgcaaggtgtacgacgagtttgtcgagaagttcatggcagcgaccgaaaaggtgaaggtcggcgatccggcagaccccgagacggtgatttgcccgctcatcaacgagcgccaggcaaaacggatcatggggctcatcgacgagagcttgaagatgggggcacgcctggtcttggagggaaagctcgaagggctgcttatgtatccatacatcctggcggatgtgactaacgacatgcccatcgcgaaaaacgagatcttcggcccggtcgcggccattctgcccgtggatagcgaggaggaggccgtgaacatcgcaaacgagtcggactatggactgtccggggcagtgtttacgggagatcttgagcgcggcatccgagtcgcccagcgcattgtcacagggatgattcacgtcaatgaccaaacggtcaatgtggagtccaatgttccatttggtggagaaaaggcttccggcatcggccgttattgtggagagtggggcattgaggagttcaccacgttgaagtggatttccgtgcagaaagagccgagagtgtatccgttttcgtaa

SEQ ID NO: 1052 - DNA, 1476 bp, Artificial
  Substituion in SEQ ID NO 1039
gtgtcgagcacaacatcggtgaagtacgctcaatggaacaaattgtatcttgggggagagtggaggtctgggacgagcagcagaacggtgacggttcgcaatccatacaatcaggaggtcctcgcggattttccgctggcatcggtggaagacatcgatcaggcctatcgaaaggcccaggccgcacagcaaggatgggctgaggagagtgcgttcactcgcgccgaggtgatggagcgcgcagctagtattctcgcgcagcggaaggatgaaatcgtccggtacttggtcgaggaaacgggaagttctcaactcaaggcgagcatcgaagtggatgcttccatcggcgacatcaagttggccgccgagtatgcgcacaaaatgacggcggtgatcctcccttccgcgattcccggcaaggagaatcgcgtgtatcgcactcccgtcggagtcgtgggcgccatcacaccgtggaattggccgttttatctgagtatccgcgtggtggcgccagcgcttgcgacggggaacgccatcgtcctcaaggcagattctcagacgcccatcaccggcggactccttgtcgcggatctgtttgagcaggcagggcttccaccagggctcttgagtgtggtggtggccgatctcgacgagatcggagacgcgatggtcgaacatccggttccccgggtgatctcgttcacagggtccacagcggcaggtcggcatatcgctgaggtcgcggcgcgatcgctgcgcaaggtggcgctcgaactcggcgggaacaacgtgttcattgtgctcgacgatgcggacgtcgaccaggcggttgccgcggcggcgttcgggaaatatcttcaccaaggccagatctgcatcgcaacaaaccgcatgattgtccatcgcaaggtgtacgacgagtttgtcgagaagttcatggcagcgaccgaaaaggtgaaggtcggcgatccggcagaccccgagacggtgatttgcccgctcatcaacgagcgccaggcaaaacggatcatggggctcatcgacgagagcttgaagatgggggcacgcctggtcttggagggaaagctcgaagggctgcttatgtatccatacatcctggcggatgtgactaacgacatgcccatcgcgaaaaacgagatcttcggcccggtcgcggccattctgcccgtggatagcgaggaggaggccgtgaacatcgcaaacgagtcggactatggactgtccggggcagtgtttacgggagatcttgagcgcggcatccgagtcgcccagcgcattgtcacagggatgattcacgtcaatgaccaaacggtcaatgtggagtccaatgttccatttggtggagaaaaggcttccggcatcggccgttattgtggagagtggggcattgaggagttcaccacgttgaagtggatttccgtgcagaaagagccgagagtgtatccgttttcgtaa

SEQ ID NO: 1053 - DNA, 1476 bp, Artificial
  Substituion in SEQ ID NO 1039
gtgtcgagcacaacatcggtgaagtacgctcaatggaacaaattgtatcttgggggagagtggaggtctgggacgagcagcagaacggtgacggttcgcaatccatacaatcaggaggtcctcgcggaatttccgctggcatcggtggaagacatcgatcaggcctatcgaaaggcccaggccgcacagcaaggatgggctgaggagagtgcgttcactcgcgccgaggtgatggagcgcgcagctagtattctcgcgcagcggaaggatgaaatcgtccggtacttggtcgaggaaacgggaagttctcaactcaaggcgagcatcgaagtggatgcttccatcggcgacatcaagttggccgccgagtatgcgcacaaaatgacggcggtgatcctcccttccgcgattcccggcaaggagaatcgcgtgtatcgcactcccgtcggagtcgtgggcgccatcacaccgtggaattggccgttttatctgagtatccgcgtggtggcgccagcgcttgcgacggggaacgccatcgtcctcaaggcagattctcagacgcccatcaccggcggactccttgtcgcggatctgtttgagcaggcagggcttccaccagggctcttgagtgtggtggtggccgatctcgacgagatcggagacgcgatggtcgaacatccggttccccgggtgatctcgttcacagggtccacagcggcaggtcggcatatcgctgaggtcgcggcgcgatcgctgcgcaaggtggcgctcgaactcggcgggaacaacgtgttcattgtgctcgacgatgcggacgtcgaccaggcggttgccgcggcggcgttcgggaaatatcttcaccaaggccagatctgcatcgcaacaaaccgcatgattgtccatcgcaaggtgtacgacgagtttgtcgagaagttcatggcagcgaccgaaaaggtgaaggtcggcgatccggcagaccccgagacggtgatttgcccgctcatcaacgagcgccaggcaaaacggatcatggggctcatcgacgagagcttgaagatgggggcacgcctggtcttggagggaaagctcgaagggctgcttatgtatccatacatcctggcggatgtgactaacgacatgcccatcgcgaaaaacgagatcttcggcccggtcgcggccattctgcccgtggatagcgaggaggaggccgtgaacatcgcaaacgagtcggactatggactgtccggggcagtgtttacgggagatcttgagcgcggcatccgagtcgcccagcgcattgtcacagggatgattcacgtcaatgaccaaacggtcaatgtggagtccaatgttccatttggtggagaaaaggcttccggcatcggccgttattgtggagagtggggcattgaggagttcaccacgttgaagtggatttccgtgcagaaagagccgagaatttatccgttttcgtaa

SEQ ID NO: 1054 - DNA, 1476 bp, Artificial
  Substituion in SEQ ID NO 1039
gtgtcgagcacaacatcggtgaagtacgctcaatggaacaaattgtatcttgggggagagtggaggtctgggacgagcagcagaacggtgacggttcgcaatccatacaatcaggaggtcctcgcggaatttccgctggcatcggtggaagacatcgatcaggcctatcgaaaggcccaggccgcacagcaaggatgggctgaggagagtgcgttcactcgcgccgaggtgatggagcgcgcagctagtattctcgcgcagcggaaggatgaaatcgtccggtacttggtcgaggaaacgggaagttctcaactcaaggcgagcatcgaagtggatgcttccatcggcgacatcaagttggccgccgagtatgcgcacaaaatgacggcggtgatcctcccttccgcgattcccggcaaggagaatcgcgtgtatcgcactcccgtcggagtcgtgggcgccatcacaccgtggaattggccgttttatctgagtatccgcgtggtggcgccagcgcttgcgacggggaacgccatcgtcctcaaggcagattctcagacgcccatcaccggcggactccttgtcgcggatctgtttgagcaggcagggcttccaccagggctcttgagtgtggtggtggccgatctcgacgagatcggagacgcgatggtcgaacatccggttccccgggtgatctcgttcacagggtccacagcggcaggtcggcatatcgctgaggtcgcggcgcgatcgctgcgcaaggtggcgctcgaactcggcgggaacaacgtgttcattgtgctcgacgatgcggacgtcgaccaggcggttgccgcggcggcgttcgggaaatatcttcaccaaggccagatctgcatcgcaacaaaccgcatgattgtccatcgcaaggtgtacgacgagtttgtcgagaagttcatggcagcgaccgaaaaggtgaaggtcggcgatccggcagaccccgagacggtgatttgcccgctcatcaacgagcgccaggcaaaacggatcatggggctcatcgacgagagcttgaagatgggggcacgcctggtcttggagggaaagctcgaagggctgcttatgtatccatacatcctggcggatgtgactaacgacatgcccatcgcgaaaaacgagatcttcggcccggtcgcggccattctgcccgtggatagcgaggaggaggccgtgaacatcgcaaacgagtcggactatggactgtccggggcagtgtttacgggagatattgagcgcggcatccgagtcgcccagcgcattgtcacagggatgattcacgtcaatgaccaaacggtcaatgtggagtccaatgttccatttggtggagaaaaggcttccggcatcggccgttattgtggagagtggggcattgaggagttcaccacgttgaagtggatttccgtgcagaaagagccgagagtgtatccgttttcgtaa

SEQ ID NO: 1055 - protein, 311 aa, Alicyclobacillus acidocaldarius
MLERKKISVIGAGFTGATTAFLLAAKELGDVVLLDIPSLENPTKGKALDMLEAMPVLGSDARVVGTSNYEDTAGSDLVIITAGLPRKPGMSRDDLVNTNANIVKSVTEQVVRHSPDACLIVLSNPVDAMTYVAYKTSGFPKQRVIGQAGVLDTARFNTFVAMELGVSVEDVHGFVLGVHGDDMVPLVRYANVGGVPLEKLLPKERIDAIVERTRNGGGEIVSLMGNASAYYAPAASLLQMAESILKDKRRVLPAIAYLEGEYGYRDLTLGVPTVLGKGGIERILELELLPEEKAALDKSAESVRRLISVLS

SEQ ID NO: 1056 - DNA, 936 bp, Alicyclobacillus acidocaldarius
atgttggagaggaagaagatctcggtgatcggcgccggattcacgggcgccaccacagcgtttttgctggcggccaaggagcttggagacgtggtcctcttggacatcccgtcgctcgagaatcccaccaaaggcaaggcgctcgacatgctcgaggctatgcctgtgctcgggagcgacgctcgcgtcgtggggacttccaattacgaggacacggccggatcggacctcgtcatcatcacggcaggactgccgcgcaagcccgggatgagccgggacgatctcgtcaatacgaacgcgaacatcgtgaagtcggtcaccgagcaggtggtccggcactcgccggacgcctgtctcatcgtcctctccaaccctgtggacgccatgacgtacgtggcgtacaagacgagcggatttccgaagcagcgcgtcatcggtcaggccggcgtgctcgacacggcccgcttcaacacgttcgtggccatggagctcggcgtgtcggtcgaagacgtgcacggcttcgtcctcggcgtgcacggcgacgacatggtgccgctcgtccgctatgcgaacgtcggcggcgtgccgctcgagaagctgctcccgaaggagcggattgacgccatcgtcgagcgcacccggaacggtgggggcgaaattgtcagcctgatgggcaacgcgagcgcgtattacgccccggccgcatcgcttctgcagatggcggagtccatcctcaaggataagcggcgcgtgttgcccgccatcgcgtatctcgaaggggagtacggctatcgagatctcacgctcggcgttccgacggtgctcggcaaaggcggcatcgagcgcatcctggagctggagcttttgccggaggaaaaggcggcgctcgacaaatcggccgaatccgtgcgcaggctgatctccgtcctctcgtga

SEQ ID NO: 1057 - protein, 308 aa, Bacillus subtilis subsp. subtilis str. 168
RKKVSVIGAGFTGATTAFLIAQKELADVVLVDIPQLENPTKGKALDMLEASPVQGFDAKITGTSNYEDTAGSDIVVITAGIARKPGMSRDDLVSTNEKIMRSVTQEIVKYSPDSIIVVLTNPVDAMTYAVYKESGFPKERVIGQSGVLDTARFRTFVAEELNLSVKDVTGFVLGGHGDDMVPLVRYSYAGGIPLETLIPKERIDAIVERTRKGGGEIVNLLGNGSAYYAPAASLTEMVEAILKDQRRVLPTIAYLEGEYGYEGIYLGVPTIVGGNGLEQIIELELTDYERAQLNKSVESVKNVMKVLS

SEQ ID NO: 1058 - protein, 309 aa, Bacillus selenitireducens MLS10
IKRRKITVVGGGFTGTTTALMTAQKELGDVVLIDIPKMEDPTKGKALDMMEASPVQGFDSKITGTSDYKDTAGSDIVVITAGIPRKPGMSRDDLVSTNAGIMKSVTQEIVKYSPDCYIIVLTNPVDAMTYTVFKESGFPKNRVIGQSGVLDTARFNTFVAEELNVSVEDVTGFVLGGHGDDMVPMLRYSFAGGIPLEKLIDKERLEAIVERTRKGGGEIVNLLGNGSAYYAPAASIVQMVEAILKDKKRILPTIAYLEGEYGYSDLYLGVPTVIGGDGIEQVFELDLNDDEKAALDKSVASVKKVMEIL

SEQ ID NO: 1059 - protein, 309 aa, Oceanobacillus iheyensis HTE831
LKRKKISVIGSGFTGATTALMVAQKELGDVVLVDIPDMEDPTKGKALDMAEAAPVQGFDAKITGTSNYADTEGSDLVIITAGIARKPGMSRDDLVNTNANIMKSVTKEIVHYSPNTTIVVLTNPVDAMTYTVFKESGLPKERVIGQSGILDTARFRTFVAEELNLSVKDVTGFVLGGHGDDMVPLIRYSYAGGIPLEKLIPQERLDAIVQRTRTGGGEIVNLLGNGSAYYAPAASLTVMAEAILKDQRRVLPTIAYLEGEYGYQDIYLGVPTILGGEGIEEIIELDLTKEEKAQLDKSADSVKNVLNVL

SEQ ID NO: 1060 - protein, 309 aa, Bacillus licheniformis ATCC 14580
KRNKVSVIGAGFTGATTAFLTAQKELADVVLVDIPQLENPTKGKALDMLEASPVQGFDANITGTANYEDTAGSDIVVITAGIARKPGMSRDDLVATNEKIMRSVTKEVVKYSPDCIIIVLTNPVDAMTYAVYKESGFPKERVIGQSGILDTARFRTFVAQELNLSVKDITGFVLGGHGDDMVPLVRYSYAGGIPLETLLPKDRIDAIVERTRKGGGEIVNLLGNGSAYYAPAASLTEMVEAILKDQRRVLPTIAYLEGEYGYEGIYLGVPTIIGGNGLEQIIELELTETEKSQLDKSVESVKNVMKVLS

SEQ ID NO: 1061 - protein, 309 aa, Bacillus israeli
IKRKKISVIGAGFTGATTAFLLAKKELGDVVLVDIPQAENPTKGKALDMLESSPVLGFDANIIGTSNYEETADSDIVVITAGIARKPGMSRDDLVQTNQKVMKSVTKEVVKYSPNSIIIVLTNPVDAMTYTVYKESGFPKHRVIGQSGVLDTARFRTFVAQELNLSVKDITGFVLGGHGDDMVPLVRYSYAGGIPLEKLIPKERLEAIVERTRKGGGEIVNLLGNGSAYYAPAASLVEMVEAIVKDQRRVLPAIAYLEGEYGFEGIYLGVPTILGGNGLEQIIELELTDEEKAALEKSAESVRNVMKAL

SEQ ID NO: 1062 - protein, 311 aa, Artificial
  Substituion in SEQ ID NO 1055
MLERKKISVIGAGFTGATTAFLLAAKELGDVVLLDIPSLENPTKGKALDMLEAMPVLGSDARVVGTSNYEDTAGSDLVIITAGLPRKPGMSRDDLVQTNANIVKSVTEQVVRHSPDACLIVLSNPVDAMTYVAYKTSGFPKQRVIGQAGVLDTARFNTFVAMELGVSVEDVHGFVLGVHGDDMVPLVRYANVGGVPLEKLLPKERIDAIVERTRNGGGEIVSLMGNASAYYAPAASLLQMAESILKDKRRVLPAIAYLEGEYGYRDLTLGVPTVLGKGGIERILELELLPEEKAALDKSAESVRRLISVLS

SEQ ID NO: 1063 - protein, 311 aa, Artificial
  Substituion in SEQ ID NO 1055
MLERKKISVIGAGFTGATTAFLLAAKELGDVVLLDIPSLENPTKGKALDMLEAMPVLGSDARVVGTSNYEDTAGSDLVIITAGLPRKPGMSRDDLVNTNAQIVKSVTEQVVRHSPDACLIVLSNPVDAMTYVAYKTSGFPKQRVIGQAGVLDTARFNTFVAMELGVSVEDVHGFVLGVHGDDMVPLVRYANVGGVPLEKLLPKERIDAIVERTRNGGGEIVSLMGNASAYYAPAASLLQMAESILKDKRRVLPAIAYLEGEYGYRDLTLGVPTVLGKGGIERILELELLPEEKAALDKSAESVRRLISVLS

SEQ ID NO: 1064 - protein, 311 aa, Artificial
  Substituion in SEQ ID NO 1055
MLERKKISVIGAGFTGATTAFLLAAKELGDVVLLDIPSLENPTKGKALDMLEAMPVLGSDARVVGTSNYEDTAGSDLVIITAGLPRKPGMSRDDLVNTNANIVKSVTEQVVRHSPDACLIVLSNPVDAMTYVAYKTSGFPKQRVIGQAGVLDTARFNTFVAMELGVSVEDVHGFVLGVHGDDMVPLVRYANVGGVPLEKLLPKERIDAIVERTRNGGGEIVSLMGNASAYYAPAASLLQMAESILKDKRRVLPAIAYLEGEYGYRDLTLGVPTVLGKGGIERILELELLPDEKAALDKSAESVRRLISVLS

SEQ ID NO: 1065 - protein, 311 aa, Artificial
  Substituion in SEQ ID NO 1055
MLERKKISVIGAGFTGATTAFLLAAKELGDVVLLDIPSLENPTKGKALDMLEAMPVLGSDARVVGTSNYEDTAGSDLVIITAGLPRKPGMSRDDLVNTNANIVKSVTEQVVRHSPDACLIVLSNPVDAMTYVAYKTSGFPKQRVIGQAGVLDTARFNTFVAMELGVSVEDVHGFVLGVHGDDMVPLVRYANVGGVPLEKLLPKERIDAIVERTRNGGGEIVSLMGNASAYYAPAASLLQMAESILKDKRRVLPAIAYLEGEYGYRDLTLGVPTVLGKGGIERILELELLPEEKAALDKSAESVRRLISILS

SEQ ID NO: 1066 - protein, 311 aa, Artificial
  Substituion in SEQ ID NO 1055
MLERKKISVIGAGFTGATTAFLIAAKELGDVVLLDIPSLENPTKGKALDMLEAMPVLGSDARVVGTSNYEDTAGSDLVIITAGLPRKPGMSRDDLVNTNANIVKSVTEQVVRHSPDACLIVLSNPVDAMTYVAYKTSGFPKQRVIGQAGVLDTARFNTFVAMELGVSVEDVHGFVLGVHGDDMVPLVRYANVGGVPLEKLLPKERIDAIVERTRNGGGEIVSLMGNASAYYAPAASLLQMAESILKDKRRVLPAIAYLEGEYGYRDLTLGVPTVLGKGGIERILELELLPEEKAALDKSAESVRRLISVLS

SEQ ID NO: 1067 - DNA, 936 bp, Artificial
  Substituion in SEQ ID NO 1056
atgttggagaggaagaagatctcggtgatcggcgccggattcacgggcgccaccacagcgtttttgctggcggccaaggagcttggagacgtggtcctcttggacatcccgtcgctcgagaatcccaccaaaggcaaggcgctcgacatgctcgaggctatgcctgtgctcgggagcgacgctcgcgtcgtggggacttccaattacgaggacacggccggatcggacctcgtcatcatcacggcaggactgccgcgcaagcccgggatgagccgggacgatctcgtccaaacgaacgcgaacatcgtgaagtcggtcaccgagcaggtggtccggcactcgccggacgcctgtctcatcgtcctctccaaccctgtggacgccatgacgtacgtggcgtacaagacgagcggatttccgaagcagcgcgtcatcggtcaggccggcgtgctcgacacggcccgcttcaacacgttcgtggccatggagctcggcgtgtcggtcgaagacgtgcacggcttcgtcctcggcgtgcacggcgacgacatggtgccgctcgtccgctatgcgaacgtcggcggcgtgccgctcgagaagctgctcccgaaggagcggattgacgccatcgtcgagcgcacccggaacggtgggggcgaaattgtcagcctgatgggcaacgcgagcgcgtattacgccccggccgcatcgcttctgcagatggcggagtccatcctcaaggataagcggcgcgtgttgcccgccatcgcgtatctcgaaggggagtacggctatcgagatctcacgctcggcgttccgacggtgctcggcaaaggcggcatcgagcgcatcctggagctggagcttttgccggaggaaaaggcggcgctcgacaaatcggccgaatccgtgcgcaggctgatctccgtcctctcgtga

SEQ ID NO: 1068 - DNA, 936 bp, Artificial
  Substituion in SEQ ID NO 1056
atgttggagaggaagaagatctcggtgatcggcgccggattcacgggcgccaccacagcgtttttgctggcggccaaggagcttggagacgtggtcctcttggacatcccgtcgctcgagaatcccaccaaaggcaaggcgctcgacatgctcgaggctatgcctgtgctcgggagcgacgctcgcgtcgtggggacttccaattacgaggacacggccggatcggacctcgtcatcatcacggcaggactgccgcgcaagcccgggatgagccgggacgatctcgtcaatacgaacgcgcaaatcgtgaagtcggtcaccgagcaggtggtccggcactcgccggacgcctgtctcatcgtcctctccaaccctgtggacgccatgacgtacgtggcgtacaagacgagcggatttccgaagcagcgcgtcatcggtcaggccggcgtgctcgacacggcccgcttcaacacgttcgtggccatggagctcggcgtgtcggtcgaagacgtgcacggcttcgtcctcggcgtgcacggcgacgacatggtgccgctcgtccgctatgcgaacgtcggcggcgtgccgctcgagaagctgctcccgaaggagcggattgacgccatcgtcgagcgcacccggaacggtgggggcgaaattgtcagcctgatgggcaacgcgagcgcgtattacgccccggccgcatcgcttctgcagatggcggagtccatcctcaaggataagcggcgcgtgttgcccgccatcgcgtatctcgaaggggagtacggctatcgagatctcacgctcggcgttccgacggtgctcggcaaaggcggcatcgagcgcatcctggagctggagcttttgccggaggaaaaggcggcgctcgacaaatcggccgaatccgtgcgcaggctgatctccgtcctctcgtga

SEQ ID NO: 1069 - DNA, 936 bp, Artificial
  Substituion in SEQ ID NO 1056
atgttggagaggaagaagatctcggtgatcggcgccggattcacgggcgccaccacagcgtttttgctggcggccaaggagcttggagacgtggtcctcttggacatcccgtcgctcgagaatcccaccaaaggcaaggcgctcgacatgctcgaggctatgcctgtgctcgggagcgacgctcgcgtcgtggggacttccaattacgaggacacggccggatcggacctcgtcatcatcacggcaggactgccgcgcaagcccgggatgagccgggacgatctcgtcaatacgaacgcgaacatcgtgaagtcggtcaccgagcaggtggtccggcactcgccggacgcctgtctcatcgtcctctccaaccctgtggacgccatgacgtacgtggcgtacaagacgagcggatttccgaagcagcgcgtcatcggtcaggccggcgtgctcgacacggcccgcttcaacacgttcgtggccatggagctcggcgtgtcggtcgaagacgtgcacggcttcgtcctcggcgtgcacggcgacgacatggtgccgctcgtccgctatgcgaacgtcggcggcgtgccgctcgagaagctgctcccgaaggagcggattgacgccatcgtcgagcgcacccggaacggtgggggcgaaattgtcagcctgatgggcaacgcgagcgcgtattacgccccggccgcatcgcttctgcagatggcggagtccatcctcaaggataagcggcgcgtgttgcccgccatcgcgtatctcgaaggggagtacggctatcgagatctcacgctcggcgttccgacggtgctcggcaaaggcggcatcgagcgcatcctggagctggagcttttgccggatgaaaaggcggcgctcgacaaatcggccgaatccgtgcgcaggctgatctccgtcctctcgtga

SEQ ID NO: 1070 - DNA, 936 bp, Artificial
  Substituion in SEQ ID NO 1056
atgttggagaggaagaagatctcggtgatcggcgccggattcacgggcgccaccacagcgtttttgctggcggccaaggagcttggagacgtggtcctcttggacatcccgtcgctcgagaatcccaccaaaggcaaggcgctcgacatgctcgaggctatgcctgtgctcgggagcgacgctcgcgtcgtggggacttccaattacgaggacacggccggatcggacctcgtcatcatcacggcaggactgccgcgcaagcccgggatgagccgggacgatctcgtcaatacgaacgcgaacatcgtgaagtcggtcaccgagcaggtggtccggcactcgccggacgcctgtctcatcgtcctctccaaccctgtggacgccatgacgtacgtggcgtacaagacgagcggatttccgaagcagcgcgtcatcggtcaggccggcgtgctcgacacggcccgcttcaacacgttcgtggccatggagctcggcgtgtcggtcgaagacgtgcacggcttcgtcctcggcgtgcacggcgacgacatggtgccgctcgtccgctatgcgaacgtcggcggcgtgccgctcgagaagctgctcccgaaggagcggattgacgccatcgtcgagcgcacccggaacggtgggggcgaaattgtcagcctgatgggcaacgcgagcgcgtattacgccccggccgcatcgcttctgcagatggcggagtccatcctcaaggataagcggcgcgtgttgcccgccatcgcgtatctcgaaggggagtacggctatcgagatctcacgctcggcgttccgacggtgctcggcaaaggcggcatcgagcgcatcctggagctggagcttttgccggaggaaaaggcggcgctcgacaaatcggccgaatccgtgcgcaggctgatctccattctctcgtga

SEQ ID NO: 1071 - DNA, 936 bp, Artificial
  Substituion in SEQ ID NO 1056
atgttggagaggaagaagatctcggtgatcggcgccggattcacgggcgccaccacagcgtttttgattgcggccaaggagcttggagacgtggtcctcttggacatcccgtcgctcgagaatcccaccaaaggcaaggcgctcgacatgctcgaggctatgcctgtgctcgggagcgacgctcgcgtcgtggggacttccaattacgaggacacggccggatcggacctcgtcatcatcacggcaggactgccgcgcaagcccgggatgagccgggacgatctcgtcaatacgaacgcgaacatcgtgaagtcggtcaccgagcaggtggtccggcactcgccggacgcctgtctcatcgtcctctccaaccctgtggacgccatgacgtacgtggcgtacaagacgagcggatttccgaagcagcgcgtcatcggtcaggccggcgtgctcgacacggcccgcttcaacacgttcgtggccatggagctcggcgtgtcggtcgaagacgtgcacggcttcgtcctcggcgtgcacggcgacgacatggtgccgctcgtccgctatgcgaacgtcggcggcgtgccgctcgagaagctgctcccgaaggagcggattgacgccatcgtcgagcgcacccggaacggtgggggcgaaattgtcagcctgatgggcaacgcgagcgcgtattacgccccggccgcatcgcttctgcagatggcggagtccatcctcaaggataagcggcgcgtgttgcccgccatcgcgtatctcgaaggggagtacggctatcgagatctcacgctcggcgttccgacggtgctcggcaaaggcggcatcgagcgcatcctggagctggagcttttgccggaggaaaaggcggcgctcgacaaatcggccgaatccgtgcgcaggctgatctccgtcctctcgtga

SEQ ID NO: 1072 - protein, 326 aa, Alicyclobacillus acidocaldarius
MSEMVSLAVRFRISTAANDYIIQGITQVCNESFHRWPDFFNRAQGGVGMQFFKMHALGNNYVFVDTARTTLPTDDLPSLARRVSDVRRGIGSDGLILVTPSDSADVGMRIWNADGSEAESCGNGLRCVARYAYERGLVDATHFSIETKAGVVAAQVHLDVEGRVRLVTIDMGEARFGTEAVPYRGADRGEDVRVEAGGARYTGTLVSMGNPHFVTLVDRVDDVDVERVGRVIESHPDFPERVNVEFVSVLAPDEIDFRVYERGSGVTFACGTGACASVAALAKKGLVRNRVTVHLLGGDLDIEIRDDGHVWMTGEAHWVCEGTYYA

SEQ ID NO: 1073 - DNA, 981 bp, Alicyclobacillus acidocaldarius
atgtctgagatggtttcgctcgcggttcgctttcgcatcagcaccgcagcgaacgattacattatacaaggaatcacacaggtttgcaacgaatcatttcatcggtggcccgattttttcaaccgtgctcaaggaggcgttggtatgcagttctttaagatgcacgcgctcggcaacaactatgtgtttgtcgatacggcccggacaaccctccccacggacgatctcccgtcgctcgcgcgtcgggtgagcgacgtgcgcagagggatcggctccgacggcctcatccttgtcacgccctccgacagcgcggatgtcggcatgcggatctggaatgcggacggatcggaggcggaatcctgcggcaacggcctgcgctgtgtggccaggtacgcttatgagcgcgggctggtcgacgccacgcacttctccattgaaaccaaggcgggcgttgtcgcggcgcaggtgcatctggacgtcgaggggcgcgtgcggcttgtgaccatcgatatgggcgaggctcgtttcggcacggaggccgtcccctatcgcggggcggatcgcggtgaggacgtgcgcgtggaggcaggcggcgcgcgctatacgggcacgctcgtcagcatgggcaacccccactttgtcacgctggtcgatcgcgtcgacgatgtggacgtcgaacgcgtcgggcgcgtcatcgagtcccatcccgactttcccgaacgcgtgaatgtggagtttgtctcggtgctcgcgccggacgagatcgacttccgcgtgtacgagcgcggttcgggcgtgacgttcgcctgcggcacgggtgcgtgcgcgagtgtggcggcgctcgccaaaaagggactcgtgcggaaccgagtgacggtgcaccttttggggggcgatctcgacatcgagattcgcgacgacggccacgtgtggatgacgggagaagcgcactgggtgtgtgaagggacgtattacgcgtag

SEQ ID NO: 1074 - protein, 280 aa, Bacillus halodurans C-125
MKFTKMHGLGNSYIYVDCFKELLKEEELPALAVAVADKNKGIGSDGMILICPSDRAPVKMRVFNNDGSEAKNCGNGLRCVAKFAFEHGYVKETSFDVETLGGLVKATVHPNDNGLVDTVTVNMGEPRLGRAQIPMLGEEAAEVVAEPFTIGEKEYRLTAVSMGNPHAIMFIDTIEDAPVEQVGPLLEKHEAFPDWVNVEFVQVVSPTEIHFRVWERGSGITQACGTGACAAVVASVLNGFTQKGQEVTVHLLGGDLTISWLENGDVLMTGAAETICEGTY

SEQ ID NO: 1075 - protein, 278 aa, Geobacillus thermodenitrificans NG80-2
FTKMHGLGNSYIYVDLFRETLPEEDLPAIARSVADVHTGIGSDGLILICPSEQAPVKMRIFNSDGSEGKNCGNGLRCVAKYAYEHGIVRDRSFLIETLSGLVEAEVTVENGEVTSVTIDMGEPRLRRSAIPMTGPEAEQVVAESFAIDGREYEITAVSMGNPHVIFYVDDIEKAPVTTLGPVVEKDARFPEGVNVEFVEVVSERELHFRVWERGSGVTQACGTGACAAVVASVLNGKTARGVETVVHLAGGDLTITWGHDGKVRMTGPAETVCTGVYY

SEQ ID NO: 1076 - protein, 278 aa, Geobacillus kaustophilus HTA426
FTKMHGLGNSYIYVDLFRETLPEEELPAIARSVADVHTGIGSDGLILICPSEKAPVKMRIFNSDGSEGKNCGNGLRCVAKYAYEHGIVSDRTFLIETLSGLVEARVAVADGEVTSVTVDMGEPRLERSAIPMLGPEAERVVAEPFAIAGGEYEITAVSMGNPHVIFYVDDIQKAPVTTLGPLVEKDPRFPEGVNVEFVEVVNERELHFRVWERGSGVTQACGTGACAAVVASVLNGKTARGEETVVHLAGGDLTIVWGHDGRVRMTGPAETVCTGVYY

SEQ ID NO: 1077 - protein, 279 aa, Bacillus pumilus SAFR-032
QFTKMHGLGNNYIYVNQMKEQLPEEKLSEIAIQVSSIYTGIGSDGMILICPSDVAPVKMRIFNNDGSEGKNCGNGLRCVAKYVYEHQIVTDTTFQIETLSGLVEATVHVQDDHVHLVTVDMGKPRFEKEAMPMLGEPASTTINEPLDFGTTTLNGTAVSMGNPHIVFYLEDIEKAPLDTLGPIIEKHDMFPEGVNVEFVEVVSETELHFRVWERGSGITQACGTGACAAAVSTIVNGQAKKETDMTVHLAGGDLIIRWKDNEHVLMTGPAETICDGTFY

SEQ ID NO: 1078 - protein, 279 aa, Bacillus subtilis subsp. subtilis str. 168
RFTKMHGLGNSYIYVNQFEEQLPEEKLSEIAIQVSSVYTGIGSDGMILICPSDQAPVKMRIFNNDGSEGKNCGNGLRCVAKYAYEHKLVEETSFLIETLSGLVKAEVQVENGKVNVVTVDMGEPRLTKSELPMLDGGEEHTINETMAFGEVELTGTAVSMGNPHIVFPIADIEQAPLTTLGPVIEKDPRFPEGINVEFVETVNEQELHFRVWERGSGITQACGTGACAAAVASVLNGVSKRNQDITVHLAGGDLVINWKDNGHVMMTGPAETVCEGVYF

SEQ ID NO: 1079 - protein, 326 aa, Artificial
  Substituion in SEQ ID NO 1072
MSEMVSLAVRFRISTAANDYIIQGITQVCNESFHRWPDFFNRAQGGVGMQFFKMHALGNNYVFVDTARTTLPTDDLPSLARRVSDVRRGIGSDGLILVTPSDSADVGMRIWNADGSEAESCGNGLRCVARYAYERGLVDATHFSIETKAGVVAAQVHLDVEGRVRLVTIDMGEARFGTEAVPYRGADRGEDVRVEAGGARYTGTLVSMGNPHFVTLVDRVDDVDVERVGRVIESHPDFPERVNVEFVSVLAPDEIDFRVYERGSGVTFACGTGACASVAALARKGLVRNRVTVHLLGGDLDIEIRDDGHVWMTGEAHWVCEGTYYA

SEQ ID NO: 1080 - protein, 326 aa, Artificial
  Substituion in SEQ ID NO 1072
MSEMVSLAVKFRISTAANDYIIQGITQVCNESFHRWPDFFNRAQGGVGMQFFKMHALGNNYVFVDTARTTLPTDDLPSLARRVSDVRRGIGSDGLILVTPSDSADVGMRIWNADGSEAESCGNGLRCVARYAYERGLVDATHFSIETKAGVVAAQVHLDVEGRVRLVTIDMGEARFGTEAVPYRGADRGEDVRVEAGGARYTGTLVSMGNPHFVTLVDRVDDVDVERVGRVIESHPDFPERVNVEFVSVLAPDEIDFRVYERGSGVTFACGTGACASVAALAKKGLVRNRVTVHLLGGDLDIEIRDDGHVWMTGEAHWVCEGTYYA

SEQ ID NO: 1081 - protein, 326 aa, Artificial
  Substituion in SEQ ID NO 1072
MSEMVSLAVRFRISTAANDYIIQGITQVCNESFHRWPDFFNRAQGGVGMQFFKMHALGNNYVFVDTARTTLPTDDLPSLARRVSDVRRGIGSDGLILVTPSDSADVGMRIWNADGSEAESCGNGLRCVARYAYERGLVDATHFSIETKAGVVAAQVHLDVEGRVRLVTIDMGEARFGTEAVPYRGADRGEDVRVEAGGARYTGTLVSMGNPHFVTLVDRVDDVDVERVGRVIESHPDFPERVNVEFVSVLAPDEIDFRVYERGSGVTFACGTGACASVAALAKKGLVKNRVTVHLLGGDLDIEIRDDGHVWMTGEAHWVCEGTYYA

SEQ ID NO: 1082 - protein, 326 aa, Artificial
  Substituion in SEQ ID NO 1072
MSEMVSLAVRFRISTAANDYIIQGITQVCNESFHRWPDFFNRAQGGVGMQFFKMHALGNNYVFVDTARTTLPTDDLPSLARRVSDVRRGIGSDGLILVTPSDSADVGMRIWNADGSEAESCGNGLRCVARYAYERGLVDATHFSIETKAGVVAAQVHLDVEGRVRLVTIDMGEARFGTEAVPYRGADRGEDVRVEAGGARYTGTLVSMGNPHFVTLVDRVDDVDVERVGRVIESHPDFPERVNVEFVSVLAPDEIDFRVYERGSGVTFACGTGACASVAALAKKGIVRNRVTVHLLGGDLDIEIRDDGHVWMTGEAHWVCEGTYYA

SEQ ID NO: 1083 - protein, 326 aa, Artificial
  Substituion in SEQ ID NO 1072
MSEMISLAVRFRISTAANDYIIQGITQVCNESFHRWPDFFNRAQGGVGMQFFKMHALGNNYVFVDTARTTLPTDDLPSLARRVSDVRRGIGSDGLILVTPSDSADVGMRIWNADGSEAESCGNGLRCVARYAYERGLVDATHFSIETKAGVVAAQVHLDVEGRVRLVTIDMGEARFGTEAVPYRGADRGEDVRVEAGGARYTGTLVSMGNPHFVTLVDRVDDVDVERVGRVIESHPDFPERVNVEFVSVLAPDEIDFRVYERGSGVTFACGTGACASVAALAKKGLVRNRVTVHLLGGDLDIEIRDDGHVWMTGEAHWVCEGTYYA

SEQ ID NO: 1084 - DNA, 981 bp, Artificial
  Substituion in SEQ ID NO 1073
atgtctgagatggtttcgctcgcggttcgctttcgcatcagcaccgcagcgaacgattacattatacaaggaatcacacaggtttgcaacgaatcatttcatcggtggcccgattttttcaaccgtgctcaaggaggcgttggtatgcagttctttaagatgcacgcgctcggcaacaactatgtgtttgtcgatacggcccggacaaccctccccacggacgatctcccgtcgctcgcgcgtcgggtgagcgacgtgcgcagagggatcggctccgacggcctcatccttgtcacgccctccgacagcgcggatgtcggcatgcggatctggaatgcggacggatcggaggcggaatcctgcggcaacggcctgcgctgtgtggccaggtacgcttatgagcgcgggctggtcgacgccacgcacttctccattgaaaccaaggcgggcgttgtcgcggcgcaggtgcatctggacgtcgaggggcgcgtgcggcttgtgaccatcgatatgggcgaggctcgtttcggcacggaggccgtcccctatcgcggggcggatcgcggtgaggacgtgcgcgtggaggcaggcggcgcgcgctatacgggcacgctcgtcagcatgggcaacccccactttgtcacgctggtcgatcgcgtcgacgatgtggacgtcgaacgcgtcgggcgcgtcatcgagtcccatcccgactttcccgaacgcgtgaatgtggagtttgtctcggtgctcgcgccggacgagatcgacttccgcgtgtacgagcgcggttcgggcgtgacgttcgcctgcggcacgggtgcgtgcgcgagtgtggcggcgctcgcccgtaagggactcgtgcggaaccgagtgacggtgcaccttttggggggcgatctcgacatcgagattcgcgacgacggccacgtgtggatgacgggagaagcgcactgggtgtgtgaagggacgtattacgcgtag

SEQ ID NO: 1085 - DNA, 981 bp, Artificial
  Substituion in SEQ ID NO 1073
atgtctgagatggtttcgctcgcggttaaatttcgcatcagcaccgcagcgaacgattacattatacaaggaatcacacaggtttgcaacgaatcatttcatcggtggcccgattttttcaaccgtgctcaaggaggcgttggtatgcagttctttaagatgcacgcgctcggcaacaactatgtgtttgtcgatacggcccggacaaccctccccacggacgatctcccgtcgctcgcgcgtcgggtgagcgacgtgcgcagagggatcggctccgacggcctcatccttgtcacgccctccgacagcgcggatgtcggcatgcggatctggaatgcggacggatcggaggcggaatcctgcggcaacggcctgcgctgtgtggccaggtacgcttatgagcgcgggctggtcgacgccacgcacttctccattgaaaccaaggcgggcgttgtcgcggcgcaggtgcatctggacgtcgaggggcgcgtgcggcttgtgaccatcgatatgggcgaggctcgtttcggcacggaggccgtcccctatcgcggggcggatcgcggtgaggacgtgcgcgtggaggcaggcggcgcgcgctatacgggcacgctcgtcagcatgggcaacccccactttgtcacgctggtcgatcgcgtcgacgatgtggacgtcgaacgcgtcgggcgcgtcatcgagtcccatcccgactttcccgaacgcgtgaatgtggagtttgtctcggtgctcgcgccggacgagatcgacttccgcgtgtacgagcgcggttcgggcgtgacgttcgcctgcggcacgggtgcgtgcgcgagtgtggcggcgctcgccaaaaagggactcgtgcggaaccgagtgacggtgcaccttttggggggcgatctcgacatcgagattcgcgacgacggccacgtgtggatgacgggagaagcgcactgggtgtgtgaagggacgtattacgcgtag

SEQ ID NO: 1086 - DNA, 981 bp, Artificial
  Substituion in SEQ ID NO 1073
atgtctgagatggtttcgctcgcggttcgctttcgcatcagcaccgcagcgaacgattacattatacaaggaatcacacaggtttgcaacgaatcatttcatcggtggcccgattttttcaaccgtgctcaaggaggcgttggtatgcagttctttaagatgcacgcgctcggcaacaactatgtgtttgtcgatacggcccggacaaccctccccacggacgatctcccgtcgctcgcgcgtcgggtgagcgacgtgcgcagagggatcggctccgacggcctcatccttgtcacgccctccgacagcgcggatgtcggcatgcggatctggaatgcggacggatcggaggcggaatcctgcggcaacggcctgcgctgtgtggccaggtacgcttatgagcgcgggctggtcgacgccacgcacttctccattgaaaccaaggcgggcgttgtcgcggcgcaggtgcatctggacgtcgaggggcgcgtgcggcttgtgaccatcgatatgggcgaggctcgtttcggcacggaggccgtcccctatcgcggggcggatcgcggtgaggacgtgcgcgtggaggcaggcggcgcgcgctatacgggcacgctcgtcagcatgggcaacccccactttgtcacgctggtcgatcgcgtcgacgatgtggacgtcgaacgcgtcgggcgcgtcatcgagtcccatcccgactttcccgaacgcgtgaatgtggagtttgtctcggtgctcgcgccggacgagatcgacttccgcgtgtacgagcgcggttcgggcgtgacgttcgcctgcggcacgggtgcgtgcgcgagtgtggcggcgctcgccaaaaagggactcgtgaaaaaccgagtgacggtgcaccttttggggggcgatctcgacatcgagattcgcgacgacggccacgtgtggatgacgggagaagcgcactgggtgtgtgaagggacgtattacgcgtag

SEQ ID NO: 1087 - DNA, 981 bp, Artificial
  Substituion in SEQ ID NO 1073
atgtctgagatggtttcgctcgcggttcgctttcgcatcagcaccgcagcgaacgattacattatacaaggaatcacacaggtttgcaacgaatcatttcatcggtggcccgattttttcaaccgtgctcaaggaggcgttggtatgcagttctttaagatgcacgcgctcggcaacaactatgtgtttgtcgatacggcccggacaaccctccccacggacgatctcccgtcgctcgcgcgtcgggtgagcgacgtgcgcagagggatcggctccgacggcctcatccttgtcacgccctccgacagcgcggatgtcggcatgcggatctggaatgcggacggatcggaggcggaatcctgcggcaacggcctgcgctgtgtggccaggtacgcttatgagcgcgggctggtcgacgccacgcacttctccattgaaaccaaggcgggcgttgtcgcggcgcaggtgcatctggacgtcgaggggcgcgtgcggcttgtgaccatcgatatgggcgaggctcgtttcggcacggaggccgtcccctatcgcggggcggatcgcggtgaggacgtgcgcgtggaggcaggcggcgcgcgctatacgggcacgctcgtcagcatgggcaacccccactttgtcacgctggtcgatcgcgtcgacgatgtggacgtcgaacgcgtcgggcgcgtcatcgagtcccatcccgactttcccgaacgcgtgaatgtggagtttgtctcggtgctcgcgccggacgagatcgacttccgcgtgtacgagcgcggttcgggcgtgacgttcgcctgcggcacgggtgcgtgcgcgagtgtggcggcgctcgccaaaaagggaattgtgcggaaccgagtgacggtgcaccttttggggggcgatctcgacatcgagattcgcgacgacggccacgtgtggatgacgggagaagcgcactgggtgtgtgaagggacgtattacgcgtag

SEQ ID NO: 1088 - DNA, 981 bp, Artificial
  Substituion in SEQ ID NO 1073
atgtctgagatgatttcgctcgcggttcgctttcgcatcagcaccgcagcgaacgattacattatacaaggaatcacacaggtttgcaacgaatcatttcatcggtggcccgattttttcaaccgtgctcaaggaggcgttggtatgcagttctttaagatgcacgcgctcggcaacaactatgtgtttgtcgatacggcccggacaaccctccccacggacgatctcccgtcgctcgcgcgtcgggtgagcgacgtgcgcagagggatcggctccgacggcctcatccttgtcacgccctccgacagcgcggatgtcggcatgcggatctggaatgcggacggatcggaggcggaatcctgcggcaacggcctgcgctgtgtggccaggtacgcttatgagcgcgggctggtcgacgccacgcacttctccattgaaaccaaggcgggcgttgtcgcggcgcaggtgcatctggacgtcgaggggcgcgtgcggcttgtgaccatcgatatgggcgaggctcgtttcggcacggaggccgtcccctatcgcggggcggatcgcggtgaggacgtgcgcgtggaggcaggcggcgcgcgctatacgggcacgctcgtcagcatgggcaacccccactttgtcacgctggtcgatcgcgtcgacgatgtggacgtcgaacgcgtcgggcgcgtcatcgagtcccatcccgactttcccgaacgcgtgaatgtggagtttgtctcggtgctcgcgccggacgagatcgacttccgcgtgtacgagcgcggttcgggcgtgacgttcgcctgcggcacgggtgcgtgcgcgagtgtggcggcgctcgccaaaaagggactcgtgcggaaccgagtgacggtgcaccttttggggggcgatctcgacatcgagattcgcgacgacggccacgtgtggatgacgggagaagcgcactgggtgtgtgaagggacgtattacgcgtag

SEQ ID NO: 1089 - protein, 247 aa, Alicyclobacillus acidocaldarius
MPNGWRRASRWPAVFCTCTAIPPRVHTVFSFGGLKGGTQVAVAQAAQHNREFFWRRLHTLSGVIPVGLFLLEHLFTNATALGGAAAFNEAVQAIQSLPLLHVIEFVFIFLPITYHGVFGLYVAFVSGYNANRYSFSRNVMFVLQRVTGIITFVFIIFHLWTTRFSGNAPSFDMVHELVTDNAYFAFMIVGVIAATFHFSNGLWSFAIHWGITVGRRAQRITAWVTMIMFVVLAAVGVASLIAFRMNV

SEQ ID NO: 1090 - DNA, 744 bp, Alicyclobacillus acidocaldarius
gtgccaaacgggtggcggcgtgcgtcgcgctggcctgcggtgttttgcacttgcacggcgatcccgccgcgcgtacatactgttttctcttttgggggattgaagggaggaacccaagtggcagtggcccaagcagcccagcacaaccgggagtttttctggcggcggctccacacgctctcgggcgtcattccggtgggactgttcctgctggagcacctgttcacgaacgcgacggccctgggcggtgcggcggctttcaacgaagccgtgcaagcgattcaatcgcttccgctcctgcacgtcattgagttcgtgttcatcttcctgcccatcacgtatcacggcgtgtttgggctttacgtggcgttcgtgtccggctacaacgcgaatcggtattcgttcagccgcaacgtgatgttcgtgttgcagcgggtgacgggcatcatcaccttcgtcttcatcattttccacctgtggacgacgcggttttccggcaacgcgccgtcgtttgacatggtgcacgagctcgtcaccgacaatgcgtacttcgcgttcatgatcgtgggcgtgatcgcggcgacgttccacttctcgaacggactgtggtcgttcgccattcattggggcatcacggttgggcgccgggcgcagcgcatcaccgcgtgggtgacgatgatcatgtttgtcgtgctggcggcggtcggtgtggcgtcgctgattgcgttccgcatgaacgtctga

SEQ ID NO: 1091 - protein, 198 aa, Bacillus subtilis subsp. subtilis str. 168
NREFYFRRLHSLLGVIPVGIFLIQHLVVNQFAARGAEAFNSAAHFMDSLPFRYALEIFIIFLPLIYHAVYGVYIAFTAKNNAGQYSYMRNWLFVLQRVTGIITLIFVSWHVWETRIAAQMGAEVNFDMMANILSSPAMLGFYIVGVLSTIFHFSNGLWSFAVTWGITVTPRSQRISTYVTLIIFVALSYVGLKAIFAF

SEQ ID NO: 1092 - protein, 198 aa, Bacillus licheniformis ATCC 14580
NREFVYRRLHSLLGVIPVGIFLIQHLVVNHFAASGEEAFNNAAHFMENLPFRYALEIFVIFLPLIYHAVYGVYIAFTAKNNANRFGFFRNWMFVLQRITGIITLIFVSWHVWETRIAAQMGAEVNFDMMADILSSPIMLGFYIVGVLSTIFHFSNGLWSFAVTWGITVSPRSQRIATFVTMGVFVVLSYVGLRAILAF

SEQ ID NO: 1093 - protein, 198 aa, Bacillus amyloliquefaciens FZB42
NREFYFRRLHSLLGVIPVGIFLIQHLVVNQFAARGADAFNKAAGFMDSLPFRYALEIFIIFLPLIYHAVYGVYIAFTAKNNAGHYSYFRNWMFVLQRVTGILTLIFVSWHVWQTRIAAQMGAEVNFDMMANILSSPFMLGFYIVGVLSVIFHFSNGLWSFAVTWGITVTPRSQRISTYVTLIIFLALSYVGLKAIFAF

SEQ ID NO: 1094 - protein, 198 aa, Bacillus sp. NRRL B-14911
NREFFNRRLHSLLGVIPVGLFLVQHLVVNHFATGGEESFNKAAHFMEQLPFRYVLETVVIFLPLLFHAIYGLYIAFTAKNNAGRFGFFRNWMFLLQRVSGVVTLIFITWHVWETRVAAAFGADVNFQMMENILSNPFMFWFYIVGVISTIFHFANGLWSFAVSWGITVTPRSQLISTYVTIAIFIALSIVGIRAITAF

SEQ ID NO: 1095 - protein, 198 aa, Bacillus halodurans C-125
NREFFNRRLHSLLGVIPIGIFLIQHFVVNHFATAGASAFNQAAHFMESLPFRYALEIFIIFIPILYHAIYGLYIAFQAKNNTSHYGYFRNWMFLLQRISGVFLLIFIAWHVWETRIQAAFGAEVNYDMMADILSNPFMLVFYILGVVSATFHFANGLWSFFVSWGITVSPRSQQIMTYVTVAIFFALTFVGIRAILAF

SEQ ID NO: 1096 - protein, 247 aa, Artificial
  Substituion in SEQ ID NO 1089
MPNGWRRASRWPAVFCTCTALPPRVHTVFSFGGLKGGTQVAVAQAAQHNREFFWRRLHTLSGVIPVGLFLLEHLFTNATALGGAAAFNEAVQAIQSLPLLHVIEFVFIFLPITYHGVFGLYVAFVSGYNANRYSFSRNVMFVLQRVTGIITFVFIIFHLWTTRFSGNAPSFDMVHELVTDNAYFAFMIVGVIAATFHFSNGLWSFAIHWGITVGRRAQRITAWVTMIMFVVLAAVGVASLIAFRMNV

SEQ ID NO: 1097 - protein, 247 aa, Artificial
  Substituion in SEQ ID NO 1089
MPNGWRRASRWPAVFCTCTAIPPRIHTVFSFGGLKGGTQVAVAQAAQHNREFFWRRLHTLSGVIPVGLFLLEHLFTNATALGGAAAFNEAVQAIQSLPLLHVIEFVFIFLPITYHGVFGLYVAFVSGYNANRYSFSRNVMFVLQRVTGIITFVFIIFHLWTTRFSGNAPSFDMVHELVTDNAYFAFMIVGVIAATFHFSNGLWSFAIHWGITVGRRAQRITAWVTMIMFVVLAAVGVASLIAFRMNV

SEQ ID NO: 1098 - protein, 247 aa, Artificial
  Substituion in SEQ ID NO 1089
MPNGWRRASRWPAVFCTCTAIPPRVHTIFSFGGLKGGTQVAVAQAAQHNREFFWRRLHTLSGVIPVGLFLLEHLFTNATALGGAAAFNEAVQAIQSLPLLHVIEFVFIFLPITYHGVFGLYVAFVSGYNANRYSFSRNVMFVLQRVTGIITFVFIIFHLWTTRFSGNAPSFDMVHELVTDNAYFAFMIVGVIAATFHFSNGLWSFAIHWGITVGRRAQRITAWVTMIMFVVLAAVGVASLIAFRMNV

SEQ ID NO: 1099 - protein, 247 aa, Artificial
  Substituion in SEQ ID NO 1089
MPNGWRRASRWPAVFCTCTAIPPRVHTVFSFGGLKGGTQVAIAQAAQHNREFFWRRLHTLSGVIPVGLFLLEHLFTNATALGGAAAFNEAVQAIQSLPLLHVIEFVFIFLPITYHGVFGLYVAFVSGYNANRYSFSRNVMFVLQRVTGIITFVFIIFHLWTTRFSGNAPSFDMVHELVTDNAYFAFMIVGVIAATFHFSNGLWSFAIHWGITVGRRAQRITAWVTMIMFVVLAAVGVASLIAFRMNV

SEQ ID NO: 1100 - protein, 247 aa, Artificial
  Substituion in SEQ ID NO 1089
MPNGWKRASRWPAVFCTCTAIPPRVHTVFSFGGLKGGTQVAVAQAAQHNREFFWRRLHTLSGVIPVGLFLLEHLFTNATALGGAAAFNEAVQAIQSLPLLHVIEFVFIFLPITYHGVFGLYVAFVSGYNANRYSFSRNVMFVLQRVTGIITFVFIIFHLWTTRFSGNAPSFDMVHELVTDNAYFAFMIVGVIAATFHFSNGLWSFAIHWGITVGRRAQRITAWVTMIMFVVLAAVGVASLIAFRMNV

SEQ ID NO: 1101 - DNA, 744 bp, Artificial
  Substituion in SEQ ID NO 1090
gtgccaaacgggtggcggcgtgcgtcgcgctggcctgcggtgttttgcacttgcacggcgttaccgccgcgcgtacatactgttttctcttttgggggattgaagggaggaacccaagtggcagtggcccaagcagcccagcacaaccgggagtttttctggcggcggctccacacgctctcgggcgtcattccggtgggactgttcctgctggagcacctgttcacgaacgcgacggccctgggcggtgcggcggctttcaacgaagccgtgcaagcgattcaatcgcttccgctcctgcacgtcattgagttcgtgttcatcttcctgcccatcacgtatcacggcgtgtttgggctttacgtggcgttcgtgtccggctacaacgcgaatcggtattcgttcagccgcaacgtgatgttcgtgttgcagcgggtgacgggcatcatcaccttcgtcttcatcattttccacctgtggacgacgcggttttccggcaacgcgccgtcgtttgacatggtgcacgagctcgtcaccgacaatgcgtacttcgcgttcatgatcgtgggcgtgatcgcggcgacgttccacttctcgaacggactgtggtcgttcgccattcattggggcatcacggttgggcgccgggcgcagcgcatcaccgcgtgggtgacgatgatcatgtttgtcgtgctggcggcggtcggtgtggcgtcgctgattgcgttccgcatgaacgtctga

SEQ ID NO: 1102 - DNA, 744 bp, Artificial
  Substituion in SEQ ID NO 1090
gtgccaaacgggtggcggcgtgcgtcgcgctggcctgcggtgttttgcacttgcacggcgatcccgccgcgcattcatactgttttctcttttgggggattgaagggaggaacccaagtggcagtggcccaagcagcccagcacaaccgggagtttttctggcggcggctccacacgctctcgggcgtcattccggtgggactgttcctgctggagcacctgttcacgaacgcgacggccctgggcggtgcggcggctttcaacgaagccgtgcaagcgattcaatcgcttccgctcctgcacgtcattgagttcgtgttcatcttcctgcccatcacgtatcacggcgtgtttgggctttacgtggcgttcgtgtccggctacaacgcgaatcggtattcgttcagccgcaacgtgatgttcgtgttgcagcgggtgacgggcatcatcaccttcgtcttcatcattttccacctgtggacgacgcggttttccggcaacgcgccgtcgtttgacatggtgcacgagctcgtcaccgacaatgcgtacttcgcgttcatgatcgtgggcgtgatcgcggcgacgttccacttctcgaacggactgtggtcgttcgccattcattggggcatcacggttgggcgccgggcgcagcgcatcaccgcgtgggtgacgatgatcatgtttgtcgtgctggcggcggtcggtgtggcgtcgctgattgcgttccgcatgaacgtctga

SEQ ID NO: 1103 - DNA, 744 bp, Artificial
  Substituion in SEQ ID NO 1090
gtgccaaacgggtggcggcgtgcgtcgcgctggcctgcggtgttttgcacttgcacggcgatcccgccgcgcgtacatactattttctcttttgggggattgaagggaggaacccaagtggcagtggcccaagcagcccagcacaaccgggagtttttctggcggcggctccacacgctctcgggcgtcattccggtgggactgttcctgctggagcacctgttcacgaacgcgacggccctgggcggtgcggcggctttcaacgaagccgtgcaagcgattcaatcgcttccgctcctgcacgtcattgagttcgtgttcatcttcctgcccatcacgtatcacggcgtgtttgggctttacgtggcgttcgtgtccggctacaacgcgaatcggtattcgttcagccgcaacgtgatgttcgtgttgcagcgggtgacgggcatcatcaccttcgtcttcatcattttccacctgtggacgacgcggttttccggcaacgcgccgtcgtttgacatggtgcacgagctcgtcaccgacaatgcgtacttcgcgttcatgatcgtgggcgtgatcgcggcgacgttccacttctcgaacggactgtggtcgttcgccattcattggggcatcacggttgggcgccgggcgcagcgcatcaccgcgtgggtgacgatgatcatgtttgtcgtgctggcggcggtcggtgtggcgtcgctgattgcgttccgcatgaacgtctga

SEQ ID NO: 1104 - DNA, 744 bp, Artificial
  Substituion in SEQ ID NO 1090
gtgccaaacgggtggcggcgtgcgtcgcgctggcctgcggtgttttgcacttgcacggcgatcccgccgcgcgtacatactgttttctcttttgggggattgaagggaggaacccaagtggcaattgcccaagcagcccagcacaaccgggagtttttctggcggcggctccacacgctctcgggcgtcattccggtgggactgttcctgctggagcacctgttcacgaacgcgacggccctgggcggtgcggcggctttcaacgaagccgtgcaagcgattcaatcgcttccgctcctgcacgtcattgagttcgtgttcatcttcctgcccatcacgtatcacggcgtgtttgggctttacgtggcgttcgtgtccggctacaacgcgaatcggtattcgttcagccgcaacgtgatgttcgtgttgcagcgggtgacgggcatcatcaccttcgtcttcatcattttccacctgtggacgacgcggttttccggcaacgcgccgtcgtttgacatggtgcacgagctcgtcaccgacaatgcgtacttcgcgttcatgatcgtgggcgtgatcgcggcgacgttccacttctcgaacggactgtggtcgttcgccattcattggggcatcacggttgggcgccgggcgcagcgcatcaccgcgtgggtgacgatgatcatgtttgtcgtgctggcggcggtcggtgtggcgtcgctgattgcgttccgcatgaacgtctga

SEQ ID NO: 1105 - DNA, 744 bp, Artificial
  Substituion in SEQ ID NO 1090
gtgccaaacgggtggaaacgtgcgtcgcgctggcctgcggtgttttgcacttgcacggcgatcccgccgcgcgtacatactgttttctcttttgggggattgaagggaggaacccaagtggcagtggcccaagcagcccagcacaaccgggagtttttctggcggcggctccacacgctctcgggcgtcattccggtgggactgttcctgctggagcacctgttcacgaacgcgacggccctgggcggtgcggcggctttcaacgaagccgtgcaagcgattcaatcgcttccgctcctgcacgtcattgagttcgtgttcatcttcctgcccatcacgtatcacggcgtgtttgggctttacgtggcgttcgtgtccggctacaacgcgaatcggtattcgttcagccgcaacgtgatgttcgtgttgcagcgggtgacgggcatcatcaccttcgtcttcatcattttccacctgtggacgacgcggttttccggcaacgcgccgtcgtttgacatggtgcacgagctcgtcaccgacaatgcgtacttcgcgttcatgatcgtgggcgtgatcgcggcgacgttccacttctcgaacggactgtggtcgttcgccattcattggggcatcacggttgggcgccgggcgcagcgcatcaccgcgtgggtgacgatgatcatgtttgtcgtgctggcggcggtcggtgtggcgtcgctgattgcgttccgcatgaacgtctga

SEQ ID NO: 1106 - protein, 287 aa, Alicyclobacillus acidocaldarius
MAQNSMRDIRRRIKSVRNTAQITKAMEMVAAAKLRRVQDAVQQSKPYLSKMQEMLANLSLSARLVKHPLLAVRPVRRIGYLVITADRGLAGPYNAQVVRAAMQEFGKRDKGSYAIYTVGKRGRNFFQRRGLPIAAEVVDLPDTPTYHSVRHLAENIVAAYEREEFDELYFIYNEFINAAVQRPVVRKVLPLASLGENVQGPRRNYLFEPDEESVLAALLPRYAETLVYQAVLDAKASEHAARMNAMGNATDNALELIEKLTLSLNRARQAAITTQIAEIVGGAEALK

SEQ ID NO: 1107 - DNA, 864 bp, Alicyclobacillus acidocaldarius
atggcgcaaaacagcatgcgcgacatccggcggcgcatcaagagcgtccggaatactgcgcagatcacgaaggcgatggagatggtcgcggccgccaagctgcgccgcgtgcaggatgcggttcagcagtcgaagccgtacctctcgaagatgcaggagatgctggcgaacctgtcgctctcggcgcggctcgtcaagcatccgctgctcgcggtgcgacccgtgcggcgcatcggctacctcgtcatcacggccgatcgcggcctggccgggccgtacaacgcgcaggtggtgcgcgccgcgatgcaggagtttggcaagcgagacaagggctcgtacgccatttacacggtcggcaagcgagggcggaactttttccagcgccgtgggctgccgatcgcggccgaggtcgtcgatctccccgacacgcccacgtatcactccgtgcgccatctggcggagaacatcgtcgcggcgtacgagcgcgaggagttcgacgagctgtatttcatctacaacgagttcatcaacgcggcggttcaacgcccggtggtgcgcaaagtgctgcctcttgcctcccttggcgagaacgtgcaggggccacggcgcaactatctgttcgagcccgacgaggagtcggtgctggcggctctccttccgcggtatgccgagacgctggtgtatcaggcggtgttggacgcgaaggcttccgaacatgctgcgcgcatgaatgcgatgggcaacgcgaccgacaacgcgcttgagctgatcgagaaactgacgctgtcgttgaaccgggcgcgccaggcggcgatcacgacccagatcgcggaaattgtcggtggcgcggaagcgttgaaataa

SEQ ID NO: 1108 - protein, 283 aa, Bacillus sp. TA2.A1
MREIKRRIRSVKNTRQITKAMKMVAAAKLRRAQETAENARPYADKIKEVISSIAAGTKDFSHPMLEARPVKKTGYMVITSDRGLAGPYNANILRLVSKTIEERHQSKDEYVIFAVGRKGRDFFKKRGYPVVEEVTGISDTPSLTEIQDIAQSAIGMFADETFDKLTIFYNEFVSPIVQRPVEKQLLPLTSEEVLDGPVSAYEYEPDSESVLEVLLPKYAETLIYSALLDAKASEFGARMTAMGNATDNATEMLETLTLQFNRARQAAITQEIAEIVAGANALR

SEQ ID NO: 1109 - protein, 283 aa, Geobacillus thermodenitrificans NG80-2
SLRDIKTRINSTKKTSQITKAMEMVSTSKLNRAEQNAKSFVPYMEKMQEVVANVALGAGGASHPMLISRPVKKTGYLVITSDRGLAGAYNSNVLRTVYQTIQARHSSPDEYAIIVIGRVGLNFFRKRNMPVILDITRLPDQPSFADIKEIANKAVGLFADGTFDELYMYYNHYVSAIQQDVTERKLLPLTDLADNQQRTMYEFEPSQEEILDVLLPQYAESLIYGALLDAKASEHAARMTAMKNATDNAHELIRTLTLSYNRARQASITQEITEIVAGANALQ

SEQ ID NO: 1110 - protein, 283 aa, Geobacillus kaustophilus HTA426
SLRDIKTRINATKKTSQITKAMEMVSTSKLNRAEQNAKSFVPYMEKIQEVVANVALGAGGASHPMLVSRPVKKTGYLVITSDRGLAGAYNSNVLRLVYQTIQKRHASPDEYAIIVIGRVGLSFFRKRNMPVILDITRLPDQPSFADIKEIARKTVGLFADGTFDELYMYYNHYVSAIQQEVTERKLLPLTDLAENKQRTVYEFEPSQEEILDVLLPQYAESLIYGALLDAKASEHAARMTAMKNATDNANELIRTLTLSYNRARQAAITQEITEIVAGANALQ

SEQ ID NO: 1111 - protein, 286 aa, Bacillus pumilus SAFR-032
SLRDIKSRITSTKKSSQITKAMQMVSAAKLNRAENNAKSFVPYMEKIQEVVAAIATGTSAKHPMLLSRPVKKTGYLVITSDRGLAGPFNSSILRAAYQTIQSRHQSADEYAVIVIGKIGRDFFKKRGIPVISEVTGLGDEVAFADIKELASSTVQMFSDEAFDELYMFYNHFVSAISQEVTEKKLLPLTDISAAATPNKRSASYEFEPSEEEILEVLLPQYAESLIFGALLDSKASEHAARMTAMKSATDNAKELIDSLTLSYNRARQAAITQEITEIVGGAAALE

SEQ ID NO: 1112 - protein, 281 aa, Bacillus sp. PS3
SLRDIKTRINATKKTSQITKAMEMVLTSKLNRAEKREIVRPYMEKIQEVVANVALAARASHPMLVSRPVKKTGYLVITSDRGLAGAYNSNVLRLVYQTIQKRHASPDEYAIIVIGRVGLSFFRKRNMPVILDITRLPDQPSFADIKEIARKTVGLFADGTFDELYMYYNHYVSAIQQEVTERKLLPLTDLAENKQRTVYEFEPSQEEILDVLLPQYAESLIYGALLDAKASEHAARMTAMKNATDNANELIRTLTLSYNRARQAAITQEITEIVAGANALQ

SEQ ID NO: 1113 - protein, 287 aa, Artificial
  Substituion in SEQ ID NO 1106
MAQNSMRDIRRRIKSVRNTAQITKAMEMVAAAKLRRVQDAVQQSKPYLSKMQEMLANLSLSARLVKHPLLAVRPVRRIGYLVITADRGLAGPYNAQVVRAAMQDFGKRDKGSYAIYTVGKRGRNFFQRRGLPIAAEVVDLPDTPTYHSVRHLAENIVAAYEREEFDELYFIYNEFINAAVQRPVVRKVLPLASLGENVQGPRRNYLFEPDEESVLAALLPRYAETLVYQAVLDAKASEHAARMNAMGNATDNALELIEKLTLSLNRARQAAITTQIAEIVGGAEALK

SEQ ID NO: 1114 - protein, 287 aa, Artificial
  Substituion in SEQ ID NO 1106
MAQNSMRDIRRRIKSVRNTAQITKAMEMVAAAKLRRVQDAVQQSKPYLSKMQEMLANLSLSARLVKHPLLAVRPVRRLGYLVITADRGLAGPYNAQVVRAAMQEFGKRDKGSYAIYTVGKRGRNFFQRRGLPIAAEVVDLPDTPTYHSVRHLAENIVAAYEREEFDELYFIYNEFINAAVQRPVVRKVLPLASLGENVQGPRRNYLFEPDEESVLAALLPRYAETLVYQAVLDAKASEHAARMNAMGNATDNALELIEKLTLSLNRARQAAITTQIAEIVGGAEALK

SEQ ID NO: 1115 - protein, 287 aa, Artificial
  Substituion in SEQ ID NO 1106
MAQNSMRDIRRRIKSVRNTAQITKAMEMVAAAKLRRVQDAVQNSKPYLSKMQEMLANLSLSARLVKHPLLAVRPVRRIGYLVITADRGLAGPYNAQVVRAAMQEFGKRDKGSYAIYTVGKRGRNFFQRRGLPIAAEVVDLPDTPTYHSVRHLAENIVAAYEREEFDELYFIYNEFINAAVQRPVVRKVLPLASLGENVQGPRRNYLFEPDEESVLAALLPRYAETLVYQAVLDAKASEHAARMNAMGNATDNALELIEKLTLSLNRARQAAITTQIAEIVGGAEALK

SEQ ID NO: 1116 - protein, 287 aa, Artificial
  Substituion in SEQ ID NO 1106
MAQNSMRDIRRRIKSVRNTAQITKAMEMVAAAKLRRVQDAVQQSKPYLSKMQEMLANLSLSARLVKHPLLAVRPVRRIGYLVITADRGLAGPYNAQVVRAAMQEFGKRDKGSYAIYTVGKRGRNFFQRRGLPIAAEVVDLPDTPTYHSVRHLAENIVAAYEREEFDELYFIYNEFINAAVQRPVIRKVLPLASLGENVQGPRRNYLFEPDEESVLAALLPRYAETLVYQAVLDAKASEHAARMNAMGNATDNALELIEKLTLSLNRARQAAITTQIAEIVGGAEALK

SEQ ID NO: 1117 - protein, 287 aa, Artificial
  Substituion in SEQ ID NO 1106
MAQNSMRDIRRRIKSVRNTAQITKAMEMVAAAKLRRVQDAVQQSKPYLSKMQEMLANLSLSARLVKHPLLAVRPVRRIGYLVITADRGLAGPYNAQVVRAAMQEFGKRDKGSYAIYTVGKRGRNFFQRRGLPIAAEVVDLPDTPTYHSVRHLAENIVAAYEREEFDELYFIYNEFINAAVQRPVVRKVLPLASLGENVQGPRRNYLFEPDEESVLAALLPRYAETLVYQAVLDAKASEHAARMNAMGNATDNALELIEKLTLSLNRARQAAITTQIAEIVGGADALK

SEQ ID NO: 1118 - DNA, 864 bp, Artificial
  Substituion in SEQ ID NO 1107
atggcgcaaaacagcatgcgcgacatccggcggcgcatcaagagcgtccggaatactgcgcagatcacgaaggcgatggagatggtcgcggccgccaagctgcgccgcgtgcaggatgcggttcagcagtcgaagccgtacctctcgaagatgcaggagatgctggcgaacctgtcgctctcggcgcggctcgtcaagcatccgctgctcgcggtgcgacccgtgcggcgcatcggctacctcgtcatcacggccgatcgcggcctggccgggccgtacaacgcgcaggtggtgcgcgccgcgatgcaggattttggcaagcgagacaagggctcgtacgccatttacacggtcggcaagcgagggcggaactttttccagcgccgtgggctgccgatcgcggccgaggtcgtcgatctccccgacacgcccacgtatcactccgtgcgccatctggcggagaacatcgtcgcggcgtacgagcgcgaggagttcgacgagctgtatttcatctacaacgagttcatcaacgcggcggttcaacgcccggtggtgcgcaaagtgctgcctcttgcctcccttggcgagaacgtgcaggggccacggcgcaactatctgttcgagcccgacgaggagtcggtgctggcggctctccttccgcggtatgccgagacgctggtgtatcaggcggtgttggacgcgaaggcttccgaacatgctgcgcgcatgaatgcgatgggcaacgcgaccgacaacgcgcttgagctgatcgagaaactgacgctgtcgttgaaccgggcgcgccaggcggcgatcacgacccagatcgcggaaattgtcggtggcgcggaagcgttgaaataa

SEQ ID NO: 1119 - DNA, 864 bp, Artificial
  Substituion in SEQ ID NO 1107
atggcgcaaaacagcatgcgcgacatccggcggcgcatcaagagcgtccggaatactgcgcagatcacgaaggcgatggagatggtcgcggccgccaagctgcgccgcgtgcaggatgcggttcagcagtcgaagccgtacctctcgaagatgcaggagatgctggcgaacctgtcgctctcggcgcggctcgtcaagcatccgctgctcgcggtgcgacccgtgcggcgcttaggctacctcgtcatcacggccgatcgcggcctggccgggccgtacaacgcgcaggtggtgcgcgccgcgatgcaggagtttggcaagcgagacaagggctcgtacgccatttacacggtcggcaagcgagggcggaactttttccagcgccgtgggctgccgatcgcggccgaggtcgtcgatctccccgacacgcccacgtatcactccgtgcgccatctggcggagaacatcgtcgcggcgtacgagcgcgaggagttcgacgagctgtatttcatctacaacgagttcatcaacgcggcggttcaacgcccggtggtgcgcaaagtgctgcctcttgcctcccttggcgagaacgtgcaggggccacggcgcaactatctgttcgagcccgacgaggagtcggtgctggcggctctccttccgcggtatgccgagacgctggtgtatcaggcggtgttggacgcgaaggcttccgaacatgctgcgcgcatgaatgcgatgggcaacgcgaccgacaacgcgcttgagctgatcgagaaactgacgctgtcgttgaaccgggcgcgccaggcggcgatcacgacccagatcgcggaaattgtcggtggcgcggaagcgttgaaataa

SEQ ID NO: 1120 - DNA, 864 bp, Artificial
  Substituion in SEQ ID NO 1107
atggcgcaaaacagcatgcgcgacatccggcggcgcatcaagagcgtccggaatactgcgcagatcacgaaggcgatggagatggtcgcggccgccaagctgcgccgcgtgcaggatgcggttcagaattcgaagccgtacctctcgaagatgcaggagatgctggcgaacctgtcgctctcggcgcggctcgtcaagcatccgctgctcgcggtgcgacccgtgcggcgcatcggctacctcgtcatcacggccgatcgcggcctggccgggccgtacaacgcgcaggtggtgcgcgccgcgatgcaggagtttggcaagcgagacaagggctcgtacgccatttacacggtcggcaagcgagggcggaactttttccagcgccgtgggctgccgatcgcggccgaggtcgtcgatctccccgacacgcccacgtatcactccgtgcgccatctggcggagaacatcgtcgcggcgtacgagcgcgaggagttcgacgagctgtatttcatctacaacgagttcatcaacgcggcggttcaacgcccggtggtgcgcaaagtgctgcctcttgcctcccttggcgagaacgtgcaggggccacggcgcaactatctgttcgagcccgacgaggagtcggtgctggcggctctccttccgcggtatgccgagacgctggtgtatcaggcggtgttggacgcgaaggcttccgaacatgctgcgcgcatgaatgcgatgggcaacgcgaccgacaacgcgcttgagctgatcgagaaactgacgctgtcgttgaaccgggcgcgccaggcggcgatcacgacccagatcgcggaaattgtcggtggcgcggaagcgttgaaataa

SEQ ID NO: 1121 - DNA, 864 bp, Artificial
  Substituion in SEQ ID NO 1107
atggcgcaaaacagcatgcgcgacatccggcggcgcatcaagagcgtccggaatactgcgcagatcacgaaggcgatggagatggtcgcggccgccaagctgcgccgcgtgcaggatgcggttcagcagtcgaagccgtacctctcgaagatgcaggagatgctggcgaacctgtcgctctcggcgcggctcgtcaagcatccgctgctcgcggtgcgacccgtgcggcgcatcggctacctcgtcatcacggccgatcgcggcctggccgggccgtacaacgcgcaggtggtgcgcgccgcgatgcaggagtttggcaagcgagacaagggctcgtacgccatttacacggtcggcaagcgagggcggaactttttccagcgccgtgggctgccgatcgcggccgaggtcgtcgatctccccgacacgcccacgtatcactccgtgcgccatctggcggagaacatcgtcgcggcgtacgagcgcgaggagttcgacgagctgtatttcatctacaacgagttcatcaacgcggcggttcaacgcccggtgattcgcaaagtgctgcctcttgcctcccttggcgagaacgtgcaggggccacggcgcaactatctgttcgagcccgacgaggagtcggtgctggcggctctccttccgcggtatgccgagacgctggtgtatcaggcggtgttggacgcgaaggcttccgaacatgctgcgcgcatgaatgcgatgggcaacgcgaccgacaacgcgcttgagctgatcgagaaactgacgctgtcgttgaaccgggcgcgccaggcggcgatcacgacccagatcgcggaaattgtcggtggcgcggaagcgttgaaataa

SEQ ID NO: 1122 - DNA, 864 bp, Artificial
  Substituion in SEQ ID NO 1107
atggcgcaaaacagcatgcgcgacatccggcggcgcatcaagagcgtccggaatactgcgcagatcacgaaggcgatggagatggtcgcggccgccaagctgcgccgcgtgcaggatgcggttcagcagtcgaagccgtacctctcgaagatgcaggagatgctggcgaacctgtcgctctcggcgcggctcgtcaagcatccgctgctcgcggtgcgacccgtgcggcgcatcggctacctcgtcatcacggccgatcgcggcctggccgggccgtacaacgcgcaggtggtgcgcgccgcgatgcaggagtttggcaagcgagacaagggctcgtacgccatttacacggtcggcaagcgagggcggaactttttccagcgccgtgggctgccgatcgcggccgaggtcgtcgatctccccgacacgcccacgtatcactccgtgcgccatctggcggagaacatcgtcgcggcgtacgagcgcgaggagttcgacgagctgtatttcatctacaacgagttcatcaacgcggcggttcaacgcccggtggtgcgcaaagtgctgcctcttgcctcccttggcgagaacgtgcaggggccacggcgcaactatctgttcgagcccgacgaggagtcggtgctggcggctctccttccgcggtatgccgagacgctggtgtatcaggcggtgttggacgcgaaggcttccgaacatgctgcgcgcatgaatgcgatgggcaacgcgaccgacaacgcgcttgagctgatcgagaaactgacgctgtcgttgaaccgggcgcgccaggcggcgatcacgacccagatcgcggaaattgtcggtggcgcggatgcgttgaaataa

SEQ ID NO: 1123 - protein, 596 aa, Alicyclobacillus acidocaldarius
MLTRAWEGIDVANTSIIVVGGGLAGLMTTIKVAEAGVPVKLFSLVPVKRSHSVCAQGGINGAVNTKGEGDSPWEHFDDTIYGGDFLANQPPVLGMCEAAPAIIYLMDRMGVMFNRTPEGLLDFRRFGGTKHHRTAFAGASTGQQLLYALDEQVRRYEVAGLVEKYEGWDFLGAVIDDEQICRGIVAQDLRSMEIHYFRADAVVMCTGGNGLIFGKSTNSMINTGSAASELYQQGVKYANPEMIQVHPTAIPGDDKLRLMSESARGEGGRVWTYKDGKPWYFLEEWYPEYGNLVPRDIATRAIHKVCVEMGLGVDGQNMVYLDLTHIPADVLDRKLGNILDIYEKFVGDDPRKVPMKIFPAVHYSMGGLWVDYDQMTNIPGLFAAGEADYQYHGANRLGANSLVSCIYGGMIAGPNAVRWAKNLRKSADSLPESLFEQYRRKYEQEFEEILKLDGDENPYQLHRELGKWMTDHVTVVRYNDKLKETDAKIQELQERWKRIKMSDTSRWENQVAQFTRHLKNMLIMARAITIGALMRNESRGAHYKPEFPERDDENFLKTTIAEYTPDGPKISYEDVDVSLIKPRKRNYAVSKEATKE

SEQ ID NO: 1124 - DNA, 1791 bp, Alicyclobacillus acidocaldarius
gtgcttacgcgagcatgggagggaattgacgtggcaaacacgagcatcattgtcgtgggaggcggcctggccggcctgatgaccaccatcaaggtggcggaagctggcgtgccggtgaaactgttctccttggtacctgtaaaacgttcccattccgtgtgtgctcaaggcggcatcaacggcgccgtgaacacgaagggcgagggcgactcgccgtgggagcacttcgacgacaccatctacggcggcgactttctggccaaccagcctccggttctgggcatgtgcgaggccgcgccggccatcatctatttgatggaccgcatgggcgtcatgttcaaccgcacgccggaaggactgcttgacttccgccggttcggcggcacgaagcatcaccgcacggcgttcgcgggcgcctcgacagggcagcaactgctttacgcgttggacgaacaggttcgccgatatgaagtggctggcctcgtcgagaaatacgagggatgggacttcctcggcgccgtgatcgacgacgagcagatctgccgcggcattgtggcgcaggacctgcggtccatggagatccactacttccgcgccgatgcggtggtcatgtgcaccgggggcaacggactcattttcggcaagagcaccaactcgatgatcaacacgggttcggcggcatcggagctgtaccagcagggcgtcaagtacgcgaatccggagatgatccaggttcacccgacggccatccccggggacgacaagctccgcctcatgtctgagtccgcgcgcggcgagggaggccgcgtctggacgtacaaggacggcaagccttggtacttcctggaggagtggtatcccgagtacggaaacctggtgccccgcgacatcgcgacgcgcgccattcacaaggtctgcgtggagatggggcttggcgtcgacgggcaaaacatggtctatctcgacctgacccacatcccggcggacgtgctggatcgcaagctgggcaacattctcgatatctatgagaagttcgtcggagacgatccgcgcaaggttccgatgaagatcttccctgctgtgcactattcgatgggcggactgtgggtcgactacgaccagatgaccaacatcccgggcctgttcgccgcgggcgaggccgattatcaataccacggcgcgaaccgcctcggcgcaaactcgctcgtgtcctgcatttacggcggcatgatcgcgggtccgaacgccgtgcgctgggcgaagaatctgcgcaagtccgcggatagcctgcccgagtcgctgttcgagcagtaccgccgcaagtacgagcaggaattcgaggaaattctcaagctcgacggcgacgagaacccgtaccagttgcaccgcgaacttggcaagtggatgacggatcacgtcacggtggtgcgctacaacgacaagctcaaggagacggacgccaagatccaggagcttcaggagcgctggaagcggatcaagatgtcggacacgtcgcgctgggagaaccaggtcgcccagttcacgcgccacctgaagaatatgctcattatggcgcgcgccatcaccatcggagcgctgatgagaaacgagagccgtggcgcacactacaagccggagttcccagagcgcgacgacgagaacttcctgaagacgaccatcgccgagtacacgccggacgggccgaagatctcgtacgaggacgtcgacgtctcgctgatcaagccgcgtaagcgcaactacgcggtgagcaaggaggcgaccaaggaatga

SEQ ID NO: 1125 - protein, 580 aa, Geobacillus kaustophilus HTA426
IIVVGGGLAGLMATIKIAEAGVPVELFSLVPVKRSHSVCAQGGINGAVNTKGEGDSPWEHFDDTVYGGDFLANQPPVKAMCEAAPGIIYMLDRMGVMFNRTPEGLLDFRRFGGTQHHRTAYAGATTGQQILYALDEQVRRHEVAGLVTKYEHWEFLGVVLDDEQICRGIVAQDLRSMEIKAFPADAVILATGGPGIIFGKSTNSVINTGSAASIAYQQGVYYANGEFIQIHPTAIPGDDKLRLMSESARGEGGRIWTYKDGKPWYFLEEKYPAYGNLVPRDIAAREIFHVCVDLKLGINGENMVYLDLSHKDPKELDVKLGGIIEIYEKFMGEDPRKVPMKVFPAVHYSMGGLWVDYDQMTNIKGLFAAGECDYSIHGANRLGANSLLSAIYGGMVAGPNAVRYIRGLEKSADAMPSTLYDSYVKREQEKWENILAMDGTENAYVLHKELGEWMTANVTIVRYNDRLLKTDEKIQELMERYKNISVTDTSRWSNQGATFIRQLYNMLQLARVITLGAYHRNESRGAHYKPEFPERNDEEWLKTTMARYTPDGPAFHYEDVDVSLIKPRKRDYSKKKEEVK

SEQ ID NO: 1126 - protein, 580 aa, Geobacillus thermodenitrificans NG80-2
IIVVGGGLAGLMATIKIAEAGVPVELFSLVPVKRSHSVCAQGGINGAVNTKGEGDSPWEHFDDTVYGGDFLANQPPVKAMCEAAPGIIYMLDRMGVMFNRTPEGLLDFRRFGGTQHHRTAYAGATTGQQILYALDEQVRRHEVAGLVTKYEHWEFLGVVLDDEQICRGIVAQDLRSMEIKAFPADAVILATGGPGIIFGKSTNSVINTGSAASIAYQQGVYYANGEFIQIHPTAIPGDDKLRLMSESARGEGGRVWTYKDGKPWYFLEEKYPAYGNLVPRDIAAREIFHVCVDLKLGINGENMVYLDLSHKDPKELDVKLGGIIEIYEKFMGEDPRKVPMKVFPAVHYSMGGLWVDYDQMTNIKGLFAAGECDYSIHGANRLGANSLLSAIYGGMVAGPNAVRYIRGLEKSADALPSTLFDSYVKQEQEKWENILSMDGTENAYVLHKELGEWMTANVTIVRYNDRLLKTDEKIQELMERYKNISVTDTAKWSNQGATFIRQLYNMLQLARVITLGAYNRNESRGAHYKPEFPERNDKEWLKTTMARYTPDGPSFHYEDVDVSLIKPRKRDYSKKKEEVK

SEQ ID NO: 1127 - protein, 581 aa, Paenibacillus macerans
MAKQSVIVVGGGLAGLMATIKSAEAGVPVHLFSLVPVKRSHSVCAQGGINGAVNTKGEGDSPWEHFDDTVYGGDFLANQPPVKAMCEAAPGIIHLMDRMGVMFNRTPEGLLDFRRFGGTKHHRTAFAGATTGQQLLYALDEQVRRHEAAGLVTKYENWEFLSVVLDDDGVCRGITAQNLRSMEIVTFASDAVILATGGPGIIFGKTTNSVINTGTAASAVYQQGVHYANGEFIQIHPTAIPGDDKLRLMSESARGEGGRIWTYKDGKPWYFLEEKYPAYGNLVPRDIATREIFHVCVDQKLGINGENMVYLDLSHKDPKELDVKLGGIIEIYEKFMGDDPRKIPMKIFPAVHYSMGGMWVDYNQMTNIPGLFAAGECEYQYHGANRLGANSLVSAIYGGMVAGPKAVEYIRGLKKSADDIRPDVFDRYRKAQEDKFEGLLNMNGSENAYVLHKELGEWMTDNMTVVRYNDRLEATINKIKELKERYKKININDTSRWNNAGAAFTRQLWNMLELAEAMTLGALLRNESRGAHYKPDFPNRNDEEFLKTTKATWTPDGPQISYEDVDVSLIPPRIRDYSKDK

SEQ ID NO: 1128 - protein, 585 aa, Bacillus licheniformis ATCC 14580
MSNSSIIVVGGGLAGLMATIKAAEAGTNVKLFSIVPVKRSHSVCAQGGINGAVNTKGEGDSPWEHFDDTVYGGDFLANQPPVKAMCEAAPSIIHLLDRMGVMFNRTPEGLLDFRRFGGTQHHRTAYAGATTGQQLLYALDEQVRRFEVEGLVSKYEGWEFLGAVLDDDNTCRGIVAQNLTTMEIESFRSDAVIMATGGPGIIFGKSTNSMINTGSAASIVYQQGAYYANGEFIQIHPTAIPGDDKLRLMSESARGEGGRVWTYKDGKPWYFLEEKYPAYGNLVPRDIATREIFDVCVRQKLGINGENMVYLDLSHKDPKELDIKLGGIIEIYEKFMGDDPRKLPMKIFPAVHYSMGGLWVDYDQMTNIPGLFAAGECDYSMHGGNRLGANSLLSAIYGGMVAGPKAVEYIQGLETSAEDLSSSVFDAYVKKEEEKWADIMKMDGNENAYVLHKELGEWMTDNVTVVRYNDKLLKTDEKIQELAERYRNININDTAKWSNQGAVFTRQLHNMLQLARVITLGAYNRNESRGAHYKPDFPERNDEEWLKTTMAKHAGDFEAPKFHYEDVDVSLIAPRKRDYSKKKVA

SEQ ID NO: 1129 - protein, 579 aa, Bacillus halodurans C-125
VIVVGGGLAGLMATIKVAEAGVPVELFSLVPVKRSHSVCAQGGINGAVNTKGEGDSPWEHFDDTVYGGDFLANQPPVKAMCDAAPGIIHLMDRMGVMFNRTAEGLLDFRRFGGTQHHRTAFAGATTGQQLLYALDEQVRRHETSGLVTKYEGWEFISAIIDDEGICRGITAQNLKTSEFQSFSADAVIMATGGPGIIFGKSTNSVINTGYAAAKLYEQGVYYANGEFIQIHPTAIPGDDKLRLMSESARGEGGRVWTYKDGKPWYFLEEKYPAYGNLVPRDIATREIFHVCVDLKLGINGENMVYLDLSHKDPKELDIKLGGIIEIYEKFMGDDPRKVPMKIFPAVHYSMGGMWIDYDQMTNIPGLFAAGECDYSQHGANRLGANSLLSAIFGGMVAGPKAVEYMNGLEKSAESMPSSLFEGELKKEQEKFDDILKMDGKENAYVLHKELGEWMTDNVTVVRYNDKLLKTDEKIQELMERYKNIDINDTAKWSNQGASFTRQLDGMLKLARVITLGAYNRNESRGAHYKPDFPERNDEEFLKTTKAKFNPETLAPEFEYEEVDVSLIEPRKRDYSQKKQ

SEQ ID NO: 1130 - protein, 596 aa, Artificial
  Substituion in SEQ ID NO 1123
MLTRAWEGIDVANTSIIVVGGGLAGLMTTIKVAEAGVPVKLFSLVPVKRSHSVCAQGGINGAVNTKGEGDSPWEHFDDTIYGGDFLANQPPVLGMCEAAPAIIYLMDRMGVMFNRTPEGLLDFRRFGGTKHHRTAFAGASTGQQLLYALDEQVRRYEVAGLVEKYEGWDFLGAVIDDEQICRGIVAQDLRSMEIHYFRADAVVMCTGGNGLIFGKSTNSMINTGSAASDLYQQGVKYANPEMIQVHPTAIPGDDKLRLMSESARGEGGRVWTYKDGKPWYFLEEWYPEYGNLVPRDIATRAIHKVCVEMGLGVDGQNMVYLDLTHIPADVLDRKLGNILDIYEKFVGDDPRKVPMKIFPAVHYSMGGLWVDYDQMTNIPGLFAAGEADYQYHGANRLGANSLVSCIYGGMIAGPNAVRWAKNLRKSADSLPESLFEQYRRKYEQEFEEILKLDGDENPYQLHRELGKWMTDHVTVVRYNDKLKETDAKIQELQERWKRIKMSDTSRWENQVAQFTRHLKNMLIMARAITIGALMRNESRGAHYKPEFPERDDENFLKTTIAEYTPDGPKISYEDVDVSLIKPRKRNYAVSKEATKE

SEQ ID NO: 1131 - protein, 596 aa, Artificial
  Substituion in SEQ ID NO 1123
MLTRAWEGIDVAQTSIIVVGGGLAGLMTTIKVAEAGVPVKLFSLVPVKRSHSVCAQGGINGAVNTKGEGDSPWEHFDDTIYGGDFLANQPPVLGMCEAAPAIIYLMDRMGVMFNRTPEGLLDFRRFGGTKHHRTAFAGASTGQQLLYALDEQVRRYEVAGLVEKYEGWDFLGAVIDDEQICRGIVAQDLRSMEIHYFRADAVVMCTGGNGLIFGKSTNSMINTGSAASELYQQGVKYANPEMIQVHPTAIPGDDKLRLMSESARGEGGRVWTYKDGKPWYFLEEWYPEYGNLVPRDIATRAIHKVCVEMGLGVDGQNMVYLDLTHIPADVLDRKLGNILDIYEKFVGDDPRKVPMKIFPAVHYSMGGLWVDYDQMTNIPGLFAAGEADYQYHGANRLGANSLVSCIYGGMIAGPNAVRWAKNLRKSADSLPESLFEQYRRKYEQEFEEILKLDGDENPYQLHRELGKWMTDHVTVVRYNDKLKETDAKIQELQERWKRIKMSDTSRWENQVAQFTRHLKNMLIMARAITIGALMRNESRGAHYKPEFPERDDENFLKTTIAEYTPDGPKISYEDVDVSLIKPRKRNYAVSKEATKE

SEQ ID NO: 1132 - protein, 596 aa, Artificial
  Substituion in SEQ ID NO 1123
MLTRAWEGIDVANTSIIVVGGGLAGLMTTIKVAEAGVPVKLFSLVPVKRSHSVCAQGGINGAVNTKGEGDSPWEHFDDTIYGGDFLANQPPVLGMCEAAPAIIYLMDRMGVMFNRTPEGLLDFRRFGGTKHHRTAFAGASTGQQLLYALDEQVRRYEVAGLVEKYEGWDFLGAVIDDEQICRGIVAQDLRSMEIHYFRADAVVMCTGGNGLIFGKSTNSMINTGSAASELYQQGVKYANPEMIQVHPTAIPGDDKLRLMSESARGEGGRVWTYKDGKPWYFLEEWYPEYGNLVPRDIATRAIHKVCVEMGLGVDGQNMVYLDLTHIPADVLDRKLGNILDIYEKFVGDDPRKVPMKIFPAVHYSMGGLWVDYDQMTNIPGLFAAGEADYQYHGANRLGANSLVSCIYGGMIAGPNAVRWAKNLRKSADSLPESLFEQYRRKYEQEFEEILKLDGDENPYQLHRELGKWMTDHVTVVRYNDKLKDTDAKIQELQERWKRIKMSDTSRWENQVAQFTRHLKNMLIMARAITIGALMRNESRGAHYKPEFPERDDENFLKTTIAEYTPDGPKISYEDVDVSLIKPRKRNYAVSKEATKE

SEQ ID NO: 1133 - protein, 596 aa, Artificial
  Substituion in SEQ ID NO 1123
MLTRAWEGIDVANTSIIVVGGGLAGLMTTIKVAEAGVPVKLFSLVPVKRSHSVCAQGGINGAVNTKGEGDSPWEHFDDTIYGGDFLANQPPVLGMCEAAPAIIYLMDRMGVMFNRTPEGLLDFRRFGGTKHHRTAFAGASTGQQLLYALDEQVRRYEVAGLVEKYEGWDFLGAVIDDEQICRGIVAQDLKSMEIHYFRADAVVMCTGGNGLIFGKSTNSMINTGSAASELYQQGVKYANPEMIQVHPTAIPGDDKLRLMSESARGEGGRVWTYKDGKPWYFLEEWYPEYGNLVPRDIATRAIHKVCVEMGLGVDGQNMVYLDLTHIPADVLDRKLGNILDIYEKFVGDDPRKVPMKIFPAVHYSMGGLWVDYDQMTNIPGLFAAGEADYQYHGANRLGANSLVSCIYGGMIAGPNAVRWAKNLRKSADSLPESLFEQYRRKYEQEFEEILKLDGDENPYQLHRELGKWMTDHVTVVRYNDKLKETDAKIQELQERWKRIKMSDTSRWENQVAQFTRHLKNMLIMARAITIGALMRNESRGAHYKPEFPERDDENFLKTTIAEYTPDGPKISYEDVDVSLIKPRKRNYAVSKEATKE

SEQ ID NO: 1134 - protein, 596 aa, Artificial
  Substituion in SEQ ID NO 1123
MLTRAWEGIDVANTSIIVVGGGLAGLMTTIKVAEAGVPVKLFSLVPVKRSHSVCAQGGINGAVNTKGEGDSPWEHFDDTIYGGDFLANQPPVLGMCEAAPAIIYLMDRMGVMFNRTPEGLLDFRRFGGTKHHRTAFAGASTGQQLLYALDEQVRRYEVAGLVEKYEGWDFLGAVIDDEQICRGIVAQDLRSMEIHYFRADAVVMCTGGNGLIFGKSTNSMINTGSAASELYQQGVKYANPEMIQVHPTAIPGDDKLRLMSESARGEGGRVWTYKDGKPWYFLEEWYPEYGNLVPRDIATRAIHKVCVEMGLGVDGQNMVYLDLTHIPADVLDRKLGNILDIYEKFVGDDPRKVPMKIFPAVHYSMGGLWVDYDQMTNIPGLFAAGEADYQYHGANRLGANSLVSCIYGGMIAGPNAVRWAKNLRKSADSLPESLFEQYRRKYEQEFEEILKLDGDENPYQLHRELGKWMTDHVTVVRYNDKLKETDAKIQELQERWKRIKMSDTSRWENQVANFTRHLKNMLIMARAITIGALMRNESRGAHYKPEFPERDDENFLKTTIAEYTPDGPKISYEDVDVSLIKPRKRNYAVSKEATKE

SEQ ID NO: 1135 - DNA, 1791 bp, Artificial
  Substituion in SEQ ID NO 1124
gtgcttacgcgagcatgggagggaattgacgtggcaaacacgagcatcattgtcgtgggaggcggcctggccggcctgatgaccaccatcaaggtggcggaagctggcgtgccggtgaaactgttctccttggtacctgtaaaacgttcccattccgtgtgtgctcaaggcggcatcaacggcgccgtgaacacgaagggcgagggcgactcgccgtgggagcacttcgacgacaccatctacggcggcgactttctggccaaccagcctccggttctgggcatgtgcgaggccgcgccggccatcatctatttgatggaccgcatgggcgtcatgttcaaccgcacgccggaaggactgcttgacttccgccggttcggcggcacgaagcatcaccgcacggcgttcgcgggcgcctcgacagggcagcaactgctttacgcgttggacgaacaggttcgccgatatgaagtggctggcctcgtcgagaaatacgagggatgggacttcctcggcgccgtgatcgacgacgagcagatctgccgcggcattgtggcgcaggacctgcggtccatggagatccactacttccgcgccgatgcggtggtcatgtgcaccgggggcaacggactcattttcggcaagagcaccaactcgatgatcaacacgggttcggcggcatcggatctgtaccagcagggcgtcaagtacgcgaatccggagatgatccaggttcacccgacggccatccccggggacgacaagctccgcctcatgtctgagtccgcgcgcggcgagggaggccgcgtctggacgtacaaggacggcaagccttggtacttcctggaggagtggtatcccgagtacggaaacctggtgccccgcgacatcgcgacgcgcgccattcacaaggtctgcgtggagatggggcttggcgtcgacgggcaaaacatggtctatctcgacctgacccacatcccggcggacgtgctggatcgcaagctgggcaacattctcgatatctatgagaagttcgtcggagacgatccgcgcaaggttccgatgaagatcttccctgctgtgcactattcgatgggcggactgtgggtcgactacgaccagatgaccaacatcccgggcctgttcgccgcgggcgaggccgattatcaataccacggcgcgaaccgcctcggcgcaaactcgctcgtgtcctgcatttacggcggcatgatcgcgggtccgaacgccgtgcgctgggcgaagaatctgcgcaagtccgcggatagcctgcccgagtcgctgttcgagcagtaccgccgcaagtacgagcaggaattcgaggaaattctcaagctcgacggcgacgagaacccgtaccagttgcaccgcgaacttggcaagtggatgacggatcacgtcacggtggtgcgctacaacgacaagctcaaggagacggacgccaagatccaggagcttcaggagcgctggaagcggatcaagatgtcggacacgtcgcgctgggagaaccaggtcgcccagttcacgcgccacctgaagaatatgctcattatggcgcgcgccatcaccatcggagcgctgatgagaaacgagagccgtggcgcacactacaagccggagttcccagagcgcgacgacgagaacttcctgaagacgaccatcgccgagtacacgccggacgggccgaagatctcgtacgaggacgtcgacgtctcgctgatcaagccgcgtaagcgcaactacgcggtgagcaaggaggcgaccaaggaatga

SEQ ID NO: 1136 - DNA, 1791 bp, Artificial
  Substituion in SEQ ID NO 1124
gtgcttacgcgagcatgggagggaattgacgtggcacaaacgagcatcattgtcgtgggaggcggcctggccggcctgatgaccaccatcaaggtggcggaagctggcgtgccggtgaaactgttctccttggtacctgtaaaacgttcccattccgtgtgtgctcaaggcggcatcaacggcgccgtgaacacgaagggcgagggcgactcgccgtgggagcacttcgacgacaccatctacggcggcgactttctggccaaccagcctccggttctgggcatgtgcgaggccgcgccggccatcatctatttgatggaccgcatgggcgtcatgttcaaccgcacgccggaaggactgcttgacttccgccggttcggcggcacgaagcatcaccgcacggcgttcgcgggcgcctcgacagggcagcaactgctttacgcgttggacgaacaggttcgccgatatgaagtggctggcctcgtcgagaaatacgagggatgggacttcctcggcgccgtgatcgacgacgagcagatctgccgcggcattgtggcgcaggacctgcggtccatggagatccactacttccgcgccgatgcggtggtcatgtgcaccgggggcaacggactcattttcggcaagagcaccaactcgatgatcaacacgggttcggcggcatcggagctgtaccagcagggcgtcaagtacgcgaatccggagatgatccaggttcacccgacggccatccccggggacgacaagctccgcctcatgtctgagtccgcgcgcggcgagggaggccgcgtctggacgtacaaggacggcaagccttggtacttcctggaggagtggtatcccgagtacggaaacctggtgccccgcgacatcgcgacgcgcgccattcacaaggtctgcgtggagatggggcttggcgtcgacgggcaaaacatggtctatctcgacctgacccacatcccggcggacgtgctggatcgcaagctgggcaacattctcgatatctatgagaagttcgtcggagacgatccgcgcaaggttccgatgaagatcttccctgctgtgcactattcgatgggcggactgtgggtcgactacgaccagatgaccaacatcccgggcctgttcgccgcgggcgaggccgattatcaataccacggcgcgaaccgcctcggcgcaaactcgctcgtgtcctgcatttacggcggcatgatcgcgggtccgaacgccgtgcgctgggcgaagaatctgcgcaagtccgcggatagcctgcccgagtcgctgttcgagcagtaccgccgcaagtacgagcaggaattcgaggaaattctcaagctcgacggcgacgagaacccgtaccagttgcaccgcgaacttggcaagtggatgacggatcacgtcacggtggtgcgctacaacgacaagctcaaggagacggacgccaagatccaggagcttcaggagcgctggaagcggatcaagatgtcggacacgtcgcgctgggagaaccaggtcgcccagttcacgcgccacctgaagaatatgctcattatggcgcgcgccatcaccatcggagcgctgatgagaaacgagagccgtggcgcacactacaagccggagttcccagagcgcgacgacgagaacttcctgaagacgaccatcgccgagtacacgccggacgggccgaagatctcgtacgaggacgtcgacgtctcgctgatcaagccgcgtaagcgcaactacgcggtgagcaaggaggcgaccaaggaatga

SEQ ID NO: 1137 - DNA, 1791 bp, Artificial
  Substituion in SEQ ID NO 1124
gtgcttacgcgagcatgggagggaattgacgtggcaaacacgagcatcattgtcgtgggaggcggcctggccggcctgatgaccaccatcaaggtggcggaagctggcgtgccggtgaaactgttctccttggtacctgtaaaacgttcccattccgtgtgtgctcaaggcggcatcaacggcgccgtgaacacgaagggcgagggcgactcgccgtgggagcacttcgacgacaccatctacggcggcgactttctggccaaccagcctccggttctgggcatgtgcgaggccgcgccggccatcatctatttgatggaccgcatgggcgtcatgttcaaccgcacgccggaaggactgcttgacttccgccggttcggcggcacgaagcatcaccgcacggcgttcgcgggcgcctcgacagggcagcaactgctttacgcgttggacgaacaggttcgccgatatgaagtggctggcctcgtcgagaaatacgagggatgggacttcctcggcgccgtgatcgacgacgagcagatctgccgcggcattgtggcgcaggacctgcggtccatggagatccactacttccgcgccgatgcggtggtcatgtgcaccgggggcaacggactcattttcggcaagagcaccaactcgatgatcaacacgggttcggcggcatcggagctgtaccagcagggcgtcaagtacgcgaatccggagatgatccaggttcacccgacggccatccccggggacgacaagctccgcctcatgtctgagtccgcgcgcggcgagggaggccgcgtctggacgtacaaggacggcaagccttggtacttcctggaggagtggtatcccgagtacggaaacctggtgccccgcgacatcgcgacgcgcgccattcacaaggtctgcgtggagatggggcttggcgtcgacgggcaaaacatggtctatctcgacctgacccacatcccggcggacgtgctggatcgcaagctgggcaacattctcgatatctatgagaagttcgtcggagacgatccgcgcaaggttccgatgaagatcttccctgctgtgcactattcgatgggcggactgtgggtcgactacgaccagatgaccaacatcccgggcctgttcgccgcgggcgaggccgattatcaataccacggcgcgaaccgcctcggcgcaaactcgctcgtgtcctgcatttacggcggcatgatcgcgggtccgaacgccgtgcgctgggcgaagaatctgcgcaagtccgcggatagcctgcccgagtcgctgttcgagcagtaccgccgcaagtacgagcaggaattcgaggaaattctcaagctcgacggcgacgagaacccgtaccagttgcaccgcgaacttggcaagtggatgacggatcacgtcacggtggtgcgctacaacgacaagctcaaggatacggacgccaagatccaggagcttcaggagcgctggaagcggatcaagatgtcggacacgtcgcgctgggagaaccaggtcgcccagttcacgcgccacctgaagaatatgctcattatggcgcgcgccatcaccatcggagcgctgatgagaaacgagagccgtggcgcacactacaagccggagttcccagagcgcgacgacgagaacttcctgaagacgaccatcgccgagtacacgccggacgggccgaagatctcgtacgaggacgtcgacgtctcgctgatcaagccgcgtaagcgcaactacgcggtgagcaaggaggcgaccaaggaatga

SEQ ID NO: 1138 - DNA, 1791 bp, Artificial
  Substituion in SEQ ID NO 1124
gtgcttacgcgagcatgggagggaattgacgtggcaaacacgagcatcattgtcgtgggaggcggcctggccggcctgatgaccaccatcaaggtggcggaagctggcgtgccggtgaaactgttctccttggtacctgtaaaacgttcccattccgtgtgtgctcaaggcggcatcaacggcgccgtgaacacgaagggcgagggcgactcgccgtgggagcacttcgacgacaccatctacggcggcgactttctggccaaccagcctccggttctgggcatgtgcgaggccgcgccggccatcatctatttgatggaccgcatgggcgtcatgttcaaccgcacgccggaaggactgcttgacttccgccggttcggcggcacgaagcatcaccgcacggcgttcgcgggcgcctcgacagggcagcaactgctttacgcgttggacgaacaggttcgccgatatgaagtggctggcctcgtcgagaaatacgagggatgggacttcctcggcgccgtgatcgacgacgagcagatctgccgcggcattgtggcgcaggacctgaaatccatggagatccactacttccgcgccgatgcggtggtcatgtgcaccgggggcaacggactcattttcggcaagagcaccaactcgatgatcaacacgggttcggcggcatcggagctgtaccagcagggcgtcaagtacgcgaatccggagatgatccaggttcacccgacggccatccccggggacgacaagctccgcctcatgtctgagtccgcgcgcggcgagggaggccgcgtctggacgtacaaggacggcaagccttggtacttcctggaggagtggtatcccgagtacggaaacctggtgccccgcgacatcgcgacgcgcgccattcacaaggtctgcgtggagatggggcttggcgtcgacgggcaaaacatggtctatctcgacctgacccacatcccggcggacgtgctggatcgcaagctgggcaacattctcgatatctatgagaagttcgtcggagacgatccgcgcaaggttccgatgaagatcttccctgctgtgcactattcgatgggcggactgtgggtcgactacgaccagatgaccaacatcccgggcctgttcgccgcgggcgaggccgattatcaataccacggcgcgaaccgcctcggcgcaaactcgctcgtgtcctgcatttacggcggcatgatcgcgggtccgaacgccgtgcgctgggcgaagaatctgcgcaagtccgcggatagcctgcccgagtcgctgttcgagcagtaccgccgcaagtacgagcaggaattcgaggaaattctcaagctcgacggcgacgagaacccgtaccagttgcaccgcgaacttggcaagtggatgacggatcacgtcacggtggtgcgctacaacgacaagctcaaggagacggacgccaagatccaggagcttcaggagcgctggaagcggatcaagatgtcggacacgtcgcgctgggagaaccaggtcgcccagttcacgcgccacctgaagaatatgctcattatggcgcgcgccatcaccatcggagcgctgatgagaaacgagagccgtggcgcacactacaagccggagttcccagagcgcgacgacgagaacttcctgaagacgaccatcgccgagtacacgccggacgggccgaagatctcgtacgaggacgtcgacgtctcgctgatcaagccgcgtaagcgcaactacgcggtgagcaaggaggcgaccaaggaatga

SEQ ID NO: 1139 - DNA, 1791 bp, Artificial
  Substituion in SEQ ID NO 1124
gtgcttacgcgagcatgggagggaattgacgtggcaaacacgagcatcattgtcgtgggaggcggcctggccggcctgatgaccaccatcaaggtggcggaagctggcgtgccggtgaaactgttctccttggtacctgtaaaacgttcccattccgtgtgtgctcaaggcggcatcaacggcgccgtgaacacgaagggcgagggcgactcgccgtgggagcacttcgacgacaccatctacggcggcgactttctggccaaccagcctccggttctgggcatgtgcgaggccgcgccggccatcatctatttgatggaccgcatgggcgtcatgttcaaccgcacgccggaaggactgcttgacttccgccggttcggcggcacgaagcatcaccgcacggcgttcgcgggcgcctcgacagggcagcaactgctttacgcgttggacgaacaggttcgccgatatgaagtggctggcctcgtcgagaaatacgagggatgggacttcctcggcgccgtgatcgacgacgagcagatctgccgcggcattgtggcgcaggacctgcggtccatggagatccactacttccgcgccgatgcggtggtcatgtgcaccgggggcaacggactcattttcggcaagagcaccaactcgatgatcaacacgggttcggcggcatcggagctgtaccagcagggcgtcaagtacgcgaatccggagatgatccaggttcacccgacggccatccccggggacgacaagctccgcctcatgtctgagtccgcgcgcggcgagggaggccgcgtctggacgtacaaggacggcaagccttggtacttcctggaggagtggtatcccgagtacggaaacctggtgccccgcgacatcgcgacgcgcgccattcacaaggtctgcgtggagatggggcttggcgtcgacgggcaaaacatggtctatctcgacctgacccacatcccggcggacgtgctggatcgcaagctgggcaacattctcgatatctatgagaagttcgtcggagacgatccgcgcaaggttccgatgaagatcttccctgctgtgcactattcgatgggcggactgtgggtcgactacgaccagatgaccaacatcccgggcctgttcgccgcgggcgaggccgattatcaataccacggcgcgaaccgcctcggcgcaaactcgctcgtgtcctgcatttacggcggcatgatcgcgggtccgaacgccgtgcgctgggcgaagaatctgcgcaagtccgcggatagcctgcccgagtcgctgttcgagcagtaccgccgcaagtacgagcaggaattcgaggaaattctcaagctcgacggcgacgagaacccgtaccagttgcaccgcgaacttggcaagtggatgacggatcacgtcacggtggtgcgctacaacgacaagctcaaggagacggacgccaagatccaggagcttcaggagcgctggaagcggatcaagatgtcggacacgtcgcgctgggagaaccaggtcgccaatttcacgcgccacctgaagaatatgctcattatggcgcgcgccatcaccatcggagcgctgatgagaaacgagagccgtggcgcacactacaagccggagttcccagagcgcgacgacgagaacttcctgaagacgaccatcgccgagtacacgccggacgggccgaagatctcgtacgaggacgtcgacgtctcgctgatcaagccgcgtaagcgcaactacgcggtgagcaaggaggcgaccaaggaatga

SEQ ID NO: 1140 - protein, 262 aa, Alicyclobacillus acidocaldarius
MSTTAEAVQQAQADSGRKVHLIIERQDTPDSEPYWEEFEVPYRPGMNVIACLMEIQRNPVNKKGEPVAPVTWEMNCLEEVCGACTMVINNKPRQACSALVDKLQQPIRIRPMRTFPVVRDLVVDRSRMFEALKRIKAWIPIDGTHDLGPGPRMSSEEQQIAYELSRCFTCGACVEACPNVNDKTSFIGPFAISQARLFNMHPTGKMNKEERLQALMGEGGIFECGNAQNCVEVCPKGIPLTTSIAVMNREVTYRAIGAWLRK

SEQ ID NO: 1141 - DNA, 789 bp, Alicyclobacillus acidocaldarius
atgagcacaacagcggaggccgtgcagcaggcgcaggcggattcgggtcgcaaggtgcatctcatcatcgagcggcaggacacgccggattcggagccgtactgggaggaatttgaggttccgtatcgcccaggcatgaacgtgattgcctgtctgatggagatccagcgcaatcccgtgaacaagaagggcgagccggtcgcaccggtcacctgggagatgaactgcctggaagaggtctgcggcgcctgcaccatggtgatcaacaacaagccccgccaggcgtgttcggcgctcgtggataagttgcagcagcccatccggattcggccgatgcgcacgttcccggtggttcgcgaccttgtcgtcgaccgcagccggatgttcgaggcgctcaagcgcatcaaggcttggattccgatcgacggcacacacgatctcggcccaggtccgcgcatgtcgagcgaggagcagcagattgcgtacgagctgtctcgctgcttcacgtgcggcgcctgtgtcgaagcatgtcccaatgtgaacgacaagacgtcgttcatcggtccgttcgccatttctcaggcgcgcctgttcaacatgcacccgacgggcaagatgaacaaagaggagcgcctgcaggcgctgatgggcgaaggcggcatcttcgagtgcggcaatgcgcagaactgcgtggaggtatgtccgaagggcattccgctcacgacgtccatcgctgtgatgaaccgagaggtgacctaccgcgcgattggcgcgtggctgcgcaagtag

SEQ ID NO: 1142 - protein, 257 aa, Paenibacillus macerans
MAETEAAVKQKSGKKVKFIITRQDDPNSQPYTEEFELDYRPNMNVISALMEIQRNPVNQKGEHTAPVCWESNCLEEVCGACSMVINGKPRQACAALIDQLEQPVRIEPMRTFPVVRDLVIDRSRMFNALKRVKAWIPIDGTYDLGPGPRMPEKKRQWAYELSKCMTCGVCLEACPNVNEKTDFIGPAAISQVRLFNAHPTGAMNADERLDALMEDGGIEGCGNSQNCVRACPKGIPLTTSIAEMNRDTTKRMFKRWL

SEQ ID NO: 1143 - protein, 236 aa, Geobacillus kaustophilus HTA426
KTVRLIITRQDRPDSAPYEEEFVIPYRPNMNVISALMEIRRNPVNAKGEKTTPVAWEMNCLEEVCGACSMVINGKPRQACAALIDKLEQPIRLEPMRTFPVIRDLVIDRSRMFDALKRVKAWIPIDGTYDLGPGPRMPERKRQWAYELSKCMTCGVCLEACPNVNSKSNFIGPAPLSQVRLFNAHPTGAMHKAERLRAIMGDGGLANCGNSQNCVQSCPKGIPLTTSIAALNRETT

SEQ ID NO: 1144 - protein, 239 aa, Bacillus licheniformis ATCC 14580
KTIKFIITRQDTSDSNPYQEEFEIPYRPNMNVISALMEIRRNPVNAKGEKTSPIAWDMNCLEEVCGACSMVINGKPRQSCTALIDQLEQPIRLEPMKTFPVVRDLQVDRSRMFDSLKKVKAWVPIDGTYDLGPGPRMPERRRQWAYELSKCMTCGVCLEACPNVNDKTNFMGPAPLSQVRLFNTHPTGAMNKSERLEAIMGDGGLAECGNSQNCVQSCPKGIPLTTSIAALNRDTTVQA

SEQ ID NO: 1145 - protein, 237 aa, Bacillus halodurans C-125
VRFIITRQDDPDSSPYEEEFQVPYRQNMNVISALMEIRRNPVNSKGETSTPVAWEMNCLEEVCGACSMVINGKPRQSCTALVDQLEQPIRLEPMKTFPVVRDLVIDRSRMFDSLKKVKAWIPIDGTYDLGPGPRMAESKRQWAYELSKCMTCGVCLEACPNVNSKSEFIGPAPLSQVRLFNAHPTGEMNKEERLQAIMGDGGLANCGNSQNCVQSCPKGIPLTTSIAALNRSATLQS

SEQ ID NO: 1146 - protein, 236 aa, Bacillus coagulans 36D1
KTVTFIIQRQDNPESEPYDETFEVPYRPNMNVISALMEIRRNPVNAKGEKTTPVVWEMNCLEEVCGACSMVINGKPRQACSALVDKLQQPIRLAPMRTFPVVRDLQIDRGRMFDSLKKVKAWIPIDGTYDLGEGPRMPEKKRQWAYELAKCMTCGVCLEACPNVNSRSNFIGPAPLSQVRLFNAHPTGHMNRDERLEAIMGDGGLANCGNSQNCVQACPKGIPLTTSIAALNRETT

SEQ ID NO: 1147 - protein, 262 aa, Artificial
  Substituion in SEQ ID NO 1140
MSTTAEAVQQAQADSGRKVHLIIERQDTPDSEPYWEEFEVPYRPGMNVIACLMEIQRNPVNKKGEPVAPVTWEMNCLEEVCGACTMVINNKPRQACSALVDKLQQPIRIRPMRTFPVVRDLVVDRSRMFEALKRIKAWIPIDGTHDLGPGPRMSSEEQQIAYELSRCFTCGACVEACPNVNDKTSFIGPFAISQARLFNMHPTGRMNKEERLQALMGEGGIFECGNAQNCVEVCPKGIPLTTSIAVMNREVTYRAIGAWLRK

SEQ ID NO: 1148 - protein, 262 aa, Artificial
  Substituion in SEQ ID NO 1140
MSTTAEAVQQAQADSGRKVHLIIERQDTPDSEPYWEEFEVPYRPGMNVIACLMEIQRNPVNKKGEPVAPVTWEMNCLEEVCGACTMVINNKPRQACSALVDKLQQPIRIRPMRTFPVVRDLVVDRSRMFEALKRIKAWIPIDGTHDLGPGPRMSSEEQQLAYELSRCFTCGACVEACPNVNDKTSFIGPFAISQARLFNMHPTGKMNKEERLQALMGEGGIFECGNAQNCVEVCPKGIPLTTSIAVMNREVTYRAIGAWLRK

SEQ ID NO: 1149 - protein, 262 aa, Artificial
  Substituion in SEQ ID NO 1140
MSTTAEAVQQAQADSGRKVHLIIERQDTPDSEPYWEEFEVPYRPGMNVIACLMEIQRNPVNKKGEPVAPVTWEMNCLEEVCGACTMVINNKPRQACSALVDKLQQPIRIRPMRTFPVVRDLVVDRSRMFEALKRIKAWIPIDGTHDLGPGPRMSSEEQQIAYELSRCFTCGACVEACPNVNDKTSFIGPFAISQARLFNMHPTGKMNKEERLQALMGEGGIFECGNAQNCVEVCPKGIPLTTSIAVMNREVTYRALGAWLRK

SEQ ID NO: 1150 - protein, 262 aa, Artificial
  Substituion in SEQ ID NO 1140
MSTTAEAVQQAQADSGRKVHLIIERQDTPDSEPYWEEFEVPYRPGMNVIACLMEIQRNPVNKKGEPVAPVTWEMNCLEEVCGACTMVINNKPRQACSALVDKLQQPIRIRPMRTFPVVRDLVVDRSRMFEALKRIKAWIPIDGTHDLGPGPRMSSEEQQIAYELSRCFTCGACVEACPNVNDKTSFIGPFAISQARLFNMHPTGKMNKEERLNALMGEGGIFECGNAQNCVEVCPKGIPLTTSIAVMNREVTYRAIGAWLRK

SEQ ID NO: 1151 - protein, 262 aa, Artificial
  Substituion in SEQ ID NO 1140
MSTTAEAVQQAQADSGRKVHLIIERQDTPDSEPYWEDFEVPYRPGMNVIACLMEIQRNPVNKKGEPVAPVTWEMNCLEEVCGACTMVINNKPRQACSALVDKLQQPIRIRPMRTFPVVRDLVVDRSRMFEALKRIKAWIPIDGTHDLGPGPRMSSEEQQIAYELSRCFTCGACVEACPNVNDKTSFIGPFAISQARLFNMHPTGKMNKEERLQALMGEGGIFECGNAQNCVEVCPKGIPLTTSIAVMNREVTYRAIGAWLRK

SEQ ID NO: 1152 - DNA, 789 bp, Artificial
  Substituion in SEQ ID NO 1141
atgagcacaacagcggaggccgtgcagcaggcgcaggcggattcgggtcgcaaggtgcatctcatcatcgagcggcaggacacgccggattcggagccgtactgggaggaatttgaggttccgtatcgcccaggcatgaacgtgattgcctgtctgatggagatccagcgcaatcccgtgaacaagaagggcgagccggtcgcaccggtcacctgggagatgaactgcctggaagaggtctgcggcgcctgcaccatggtgatcaacaacaagccccgccaggcgtgttcggcgctcgtggataagttgcagcagcccatccggattcggccgatgcgcacgttcccggtggttcgcgaccttgtcgtcgaccgcagccggatgttcgaggcgctcaagcgcatcaaggcttggattccgatcgacggcacacacgatctcggcccaggtccgcgcatgtcgagcgaggagcagcagattgcgtacgagctgtctcgctgcttcacgtgcggcgcctgtgtcgaagcatgtcccaatgtgaacgacaagacgtcgttcatcggtccgttcgccatttctcaggcgcgcctgttcaacatgcacccgacgggccgtatgaacaaagaggagcgcctgcaggcgctgatgggcgaaggcggcatcttcgagtgcggcaatgcgcagaactgcgtggaggtatgtccgaagggcattccgctcacgacgtccatcgctgtgatgaaccgagaggtgacctaccgcgcgattggcgcgtggctgcgcaagtag

SEQ ID NO: 1153 - DNA, 789 bp, Artificial
  Substituion in SEQ ID NO 1141
atgagcacaacagcggaggccgtgcagcaggcgcaggcggattcgggtcgcaaggtgcatctcatcatcgagcggcaggacacgccggattcggagccgtactgggaggaatttgaggttccgtatcgcccaggcatgaacgtgattgcctgtctgatggagatccagcgcaatcccgtgaacaagaagggcgagccggtcgcaccggtcacctgggagatgaactgcctggaagaggtctgcggcgcctgcaccatggtgatcaacaacaagccccgccaggcgtgttcggcgctcgtggataagttgcagcagcccatccggattcggccgatgcgcacgttcccggtggttcgcgaccttgtcgtcgaccgcagccggatgttcgaggcgctcaagcgcatcaaggcttggattccgatcgacggcacacacgatctcggcccaggtccgcgcatgtcgagcgaggagcagcagttagcgtacgagctgtctcgctgcttcacgtgcggcgcctgtgtcgaagcatgtcccaatgtgaacgacaagacgtcgttcatcggtccgttcgccatttctcaggcgcgcctgttcaacatgcacccgacgggcaagatgaacaaagaggagcgcctgcaggcgctgatgggcgaaggcggcatcttcgagtgcggcaatgcgcagaactgcgtggaggtatgtccgaagggcattccgctcacgacgtccatcgctgtgatgaaccgagaggtgacctaccgcgcgattggcgcgtggctgcgcaagtag

SEQ ID NO: 1154 - DNA, 789 bp, Artificial
  Substituion in SEQ ID NO 1141
atgagcacaacagcggaggccgtgcagcaggcgcaggcggattcgggtcgcaaggtgcatctcatcatcgagcggcaggacacgccggattcggagccgtactgggaggaatttgaggttccgtatcgcccaggcatgaacgtgattgcctgtctgatggagatccagcgcaatcccgtgaacaagaagggcgagccggtcgcaccggtcacctgggagatgaactgcctggaagaggtctgcggcgcctgcaccatggtgatcaacaacaagccccgccaggcgtgttcggcgctcgtggataagttgcagcagcccatccggattcggccgatgcgcacgttcccggtggttcgcgaccttgtcgtcgaccgcagccggatgttcgaggcgctcaagcgcatcaaggcttggattccgatcgacggcacacacgatctcggcccaggtccgcgcatgtcgagcgaggagcagcagattgcgtacgagctgtctcgctgcttcacgtgcggcgcctgtgtcgaagcatgtcccaatgtgaacgacaagacgtcgttcatcggtccgttcgccatttctcaggcgcgcctgttcaacatgcacccgacgggcaagatgaacaaagaggagcgcctgcaggcgctgatgggcgaaggcggcatcttcgagtgcggcaatgcgcagaactgcgtggaggtatgtccgaagggcattccgctcacgacgtccatcgctgtgatgaaccgagaggtgacctaccgcgcgttaggcgcgtggctgcgcaagtag

SEQ ID NO: 1155 - DNA, 789 bp, Artificial
  Substituion in SEQ ID NO 1141
atgagcacaacagcggaggccgtgcagcaggcgcaggcggattcgggtcgcaaggtgcatctcatcatcgagcggcaggacacgccggattcggagccgtactgggaggaatttgaggttccgtatcgcccaggcatgaacgtgattgcctgtctgatggagatccagcgcaatcccgtgaacaagaagggcgagccggtcgcaccggtcacctgggagatgaactgcctggaagaggtctgcggcgcctgcaccatggtgatcaacaacaagccccgccaggcgtgttcggcgctcgtggataagttgcagcagcccatccggattcggccgatgcgcacgttcccggtggttcgcgaccttgtcgtcgaccgcagccggatgttcgaggcgctcaagcgcatcaaggcttggattccgatcgacggcacacacgatctcggcccaggtccgcgcatgtcgagcgaggagcagcagattgcgtacgagctgtctcgctgcttcacgtgcggcgcctgtgtcgaagcatgtcccaatgtgaacgacaagacgtcgttcatcggtccgttcgccatttctcaggcgcgcctgttcaacatgcacccgacgggcaagatgaacaaagaggagcgcctgaatgcgctgatgggcgaaggcggcatcttcgagtgcggcaatgcgcagaactgcgtggaggtatgtccgaagggcattccgctcacgacgtccatcgctgtgatgaaccgagaggtgacctaccgcgcgattggcgcgtggctgcgcaagtag

SEQ ID NO: 1156 - DNA, 789 bp, Artificial
  Substituion in SEQ ID NO 1141
atgagcacaacagcggaggccgtgcagcaggcgcaggcggattcgggtcgcaaggtgcatctcatcatcgagcggcaggacacgccggattcggagccgtactgggaggattttgaggttccgtatcgcccaggcatgaacgtgattgcctgtctgatggagatccagcgcaatcccgtgaacaagaagggcgagccggtcgcaccggtcacctgggagatgaactgcctggaagaggtctgcggcgcctgcaccatggtgatcaacaacaagccccgccaggcgtgttcggcgctcgtggataagttgcagcagcccatccggattcggccgatgcgcacgttcccggtggttcgcgaccttgtcgtcgaccgcagccggatgttcgaggcgctcaagcgcatcaaggcttggattccgatcgacggcacacacgatctcggcccaggtccgcgcatgtcgagcgaggagcagcagattgcgtacgagctgtctcgctgcttcacgtgcggcgcctgtgtcgaagcatgtcccaatgtgaacgacaagacgtcgttcatcggtccgttcgccatttctcaggcgcgcctgttcaacatgcacccgacgggcaagatgaacaaagaggagcgcctgcaggcgctgatgggcgaaggcggcatcttcgagtgcggcaatgcgcagaactgcgtggaggtatgtccgaagggcattccgctcacgacgtccatcgctgtgatgaaccgagaggtgacctaccgcgcgattggcgcgtggctgcgcaagtag

SEQ ID NO: 1157 - protein, 398 aa, Alicyclobacillus acidocaldarius
MMDFSLSQEQMAVRDVVRKFVDEEILPHIREWDEKQHFEPGVLRRLAELGLMGVCIPEKYGGAGMDYNTLAIVCEELERGDIAFRTAVSVHTGLNSLTLLQWGTEEQKQKYLVPQARGEKIGAFGLTEPNAGSDVAAMRTTAVRDGDSYILNGSKIWISLADVADHFLVFAYTDRSKKHHGITAFIVERGWEGFSTRSIKGKLGIRAGNTGELFFDHVRVPIENRLGEEGEGFKIAMSALDNGRFTVAAGACGCIAACLEASVKYCHERETFGQPIGKHQLVQQMIAKMAANLDISRLLVYRAGWLKNQGLPNTRETSLAKWVACDAAWEAASDAVQIHGAYGYSNEYPVERYLRNAKAPVIYEGTREIHTILQAEYALGYRRDKPLSRRLPAWPFEE

SEQ ID NO: 1158 - DNA, 1197 bp, Alicyclobacillus acidocaldarius
gtgatggatttcagcctgtcgcaagaacagatggcggttcgggacgtggtccgcaagttcgtggacgaggagatcttgccccacatccgcgagtgggacgagaaacagcattttgagccgggcgtgctcaggcggctggcggagctggggctcatgggcgtgtgtatccccgagaagtacggcggcgcagggatggactacaacacgctcgccattgtctgtgaagagctcgaacggggagacatcgcgtttcgaacggccgtatcggtccacacaggactcaattctctcacgctgcttcagtgggggacggaggagcagaagcaaaagtatttggtgcctcaggcgcgcggtgagaagatcggggcgtttggactcaccgagccgaacgcggggtcggacgtggccgcgatgcggacgaccgccgtgcgggacggagattcgtatattttgaacgggtcgaagatctggatttcgctcgccgacgtcgcggaccacttcctggtctttgcgtacaccgatcgctcgaagaagcatcacgggatcacggcgttcatcgtggagcgcggctgggaagggttctcgacgagatcgatcaagggcaagctcggtattcgcgcaggcaacacgggggaactgttcttcgatcacgtccgcgtgccgatcgagaatcgacttggagaagagggcgaaggcttcaagattgccatgtccgccctcgacaacgggcggttcacggtggcggccggcgcgtgcggatgcatcgcggcttgcctcgaggcgtcggtcaagtactgccatgagcgcgagacgtttggccagcccatcggcaagcaccagctagtgcagcagatgattgcgaagatggccgcgaacctggacatctcccgcttgctggtctaccgggctgggtggctgaagaaccagggcttgccgaacacgcgcgaaacctcgctcgcgaagtgggtggcgtgtgatgcagcgtgggaggcggcgtcggacgcggttcagattcacggcgcctacgggtattcgaacgagtatccggtggagaggtacctgcgaaacgccaaggcacctgtgatctatgaggggacgcgcgagatccacaccatcctgcaggcggagtacgcgctcggataccggcgagacaaaccgctgtcgcgccgacttccggcgtggccgtttgaagaatga

SEQ ID NO: 1159 - protein, 397 aa, Bacillus coagulans 36D1
MHFELTEEQELLKKTVRNFVDKEIMPFIREWDENHHFETGLLKKLADLGLMGVCIPEKYGGSGMDYNALAIVCEELERGDTAFRTAVSVHTGLNSLTLLQWGTEAQKQKYLVPQAKGEKIGAFGLTEPGAGSDVAGIGTTAEKDGDFYILNGQKTWISLCDVADHFLVFAYTDKAKKHHGISAFIVERTMPGFSSKAIKGKLGIRAGNTGELFFDNVRVPKENLLGEEGEGFKIAMSALDNGRFTVAAGACGLIQACLEASVKYCHERKTFGHEIGKHQLVQQMIAKMEAGYQMSRLLVFRAGELKNQGKRNTRETSLAKWQACDFANEAANDAVQIHGAYGYSSEYPVERYLRNSKAPVIYEGTREIHTIMQAEYVLGYRTDKPLSKMLPAWPFTE

SEQ ID NO: 1160 - protein, 397 aa, Geobacillus thermodenitrificans NG80-2
MNFDFTPEQEMLRQTVRKFVDKEIMPYIKEWDERGEFDRNIFKRLAELNLMGVCIPEQYGGMGMDYNSLAIVCEELERGDTAFRTAVSVHTGLNSLTLLQWGTEEQKQKYLIPQARGEKIGAFGLTEPNAGSDVASIQTTAVRDGDDYILNGQKTWISLADIADHFLVFAYTDKSKKHRGISAFIVERTMPGFSSRPIKGKLGIRSGNTGELFFDNVRVPKENLLGEEGEGFKIAMSALDNGRFTVAAGAVGLIMACLEASVKYCHERKTFGKEIGRHQLVQQMIARMEAGLQISRLLVYKVGFLKNEGRRCTRETSLAKWIACDYANQAADDAVQVHGAYGYSNEYPVERYLRNSKAPVIYEGTREIHTIMQAEYVLGYRKDKPLRKTLPAWRPDE

SEQ ID NO: 1161 - protein, 393 aa, Geobacillus kaustophilus HTA426
MNFDFTPEQEMLRQTVRKFVDKEIMPYIKEWDERGEFDRNIFKRLAELNLMGVCIPEEYGGMGMDYNSLAIVCEELERGDTAFRTAVSVHTGLNSLTLLQWGTEEQKQKYLVPQARGEKIGAFGLTEPNAGSDVASIQTTAVRDGDDYILNGQKTWISLADIADHFLVFAYTDKSKKHRGISAFIVERTMPGFSSRPIKGKLGIRSGNTGELFFDNVRVPKENLLGEEGEGFKIAMSALDNGRFTVAAGAVGLIMACLEASVKYCHERKTFGKEIGRHQLVQQMIARMEAGLQISRLLVYKVGFLKNEGRRCTRETSLAKWIACDYANQAADDAVQIHGAYGYSNEYPVERYLRNSKAPVIYEGTREIHTIMQAEYVLGYRQDKPLRKTLPAW

SEQ ID NO: 1162 - protein, 394 aa, Oceanobacillus iheyensis HTE831
MDFHFSEEQQLLRKTVRDFTDKEIMPYISEWDRNGKFDPTLLNKLAELGLMGVCIPEQYGGSGMDYNSLAIVCEELERGDTAFRTAVSVHTGLNSMTLLQWGNEQQKQKYLIPQAKGEKIGAFGLTEPGAGSDVAALQSTAVKQGDHYILNGQKTWISLCDIADHFIVFAYTKDRSEKHKGISAFIVERSWEGFSSKAIKGKHGIRSGNTGEIFFDHIKVPKENLLGKEGEGFKIAMSALDNGRFTVAAGAVGQIMACIEASVKYCHERETFGKEIGKHQLVQQMIAKMEAGYQMSKLLVYRAGELKNQGKRNTRETSLAKWQACDFANKAADDAVQIHGAYGYSDEYPVERFLRNSKAPVIYEGTREVHTIMQAEYVLGYREDKLLNQMLPAW

SEQ ID NO: 1163 - protein, 397 aa, Bacillus sp. B14905
MNFDMSTEHEMLRKTVRQFVDEEIIPYIAKWDAEGGFDAKIWSRLAELGLMGVCVPEQYGGSGMDYNSLAIVCEELERGDTAFRTAVSVHTGLNSMTLMQWGTEDQKQRYLIPQAKGVRIGAFGLTEPGAGSDVAAMSTTAVRDGDHYVINGQKTWISLCDIADHFIIFAYTDKSKRHHGISAFIVERSMAGFTSKAIKGKYGIRAGNTGELFFEDLRVPVENRLGVEGEGFKIAMSALDNGRFTVAAGAVGLIQACLEASVKYCHERETFGKPIGEHQLVGQMIANMEAGYQMSRLLVYRVGELKNKGVRNTRETSLAKWQACDFANKAADDAVQIHGAYGYSDEYPVARYLRNSKAPVIYEGTREIHTIMQADYVLGRRQDKPLANRLPKWPFEE

SEQ ID NO: 1164 - protein, 398 aa, Artificial
  Substituion in SEQ ID NO 1157
MMDFSLSQEQMAVRDVVRKFVDEEILPHIREWDEKQHFEPGVIRRLAELGLMGVCIPEKYGGAGMDYNTLAIVCEELERGDIAFRTAVSVHTGLNSLTLLQWGTEEQKQKYLVPQARGEKIGAFGLTEPNAGSDVAAMRTTAVRDGDSYILNGSKIWISLADVADHFLVFAYTDRSKKHHGITAFIVERGWEGFSTRSIKGKLGIRAGNTGELFFDHVRVPIENRLGEEGEGFKIAMSALDNGRFTVAAGACGCIAACLEASVKYCHERETFGQPIGKHQLVQQMIAKMAANLDISRLLVYRAGWLKNQGLPNTRETSLAKWVACDAAWEAASDAVQIHGAYGYSNEYPVERYLRNAKAPVIYEGTREIHTILQAEYALGYRRDKPLSRRLPAWPFEE

SEQ ID NO: 1165 - protein, 398 aa, Artificial
  Substituion in SEQ ID NO 1157
MMDFSLSNEQMAVRDVVRKFVDEEILPHIREWDEKQHFEPGVLRRLAELGLMGVCIPEKYGGAGMDYNTLAIVCEELERGDIAFRTAVSVHTGLNSLTLLQWGTEEQKQKYLVPQARGEKIGAFGLTEPNAGSDVAAMRTTAVRDGDSYILNGSKIWISLADVADHFLVFAYTDRSKKHHGITAFIVERGWEGFSTRSIKGKLGIRAGNTGELFFDHVRVPIENRLGEEGEGFKIAMSALDNGRFTVAAGACGCIAACLEASVKYCHERETFGQPIGKHQLVQQMIAKMAANLDISRLLVYRAGWLKNQGLPNTRETSLAKWVACDAAWEAASDAVQIHGAYGYSNEYPVERYLRNAKAPVIYEGTREIHTILQAEYALGYRRDKPLSRRLPAWPFEE

SEQ ID NO: 1166 - protein, 398 aa, Artificial
  Substituion in SEQ ID NO 1157
MMDFSLSQEQMAVRDVVRKFVDEEILPHIREWDEKQHFEPGVLRRLAELGLMGVCIPEKYGGAGMDYNTLAIVCEELERGDIAFRTAVSVHTGLNSLTLLQWGTEEQKQKYLVPQARGEKIGAFGLTEPNAGSDVAAMRTTAVRDGDSYILNGSKIWISLADVADHFLVFAYTDRSKKHHGITAFIVERGWEGFSTRSIKGKLGIRAGNTGELFFDHVRVPIENRLGEEGEGFKIAMSALDNGRFTVAAGACGCIAACLEASVKYCHERETFGQPIGKHQLVQQMIAKMAANLDISRLLVYRAGWLKNQGLPQTRETSLAKWVACDAAWEAASDAVQIHGAYGYSNEYPVERYLRNAKAPVIYEGTREIHTILQAEYALGYRRDKPLSRRLPAWPFEE

SEQ ID NO: 1167 - protein, 398 aa, Artificial
  Substituion in SEQ ID NO 1157
MMDFSLSQEQMAVRDVVRKFVDEEILPHIREWDEKQHFEPGVLRRLAELGLMGVCIPEKYGGAGMDYNTLAIVCEELERGDIAFRTAVSVHTGLNSLTLLQWGTEEQKQKYLVPQARGEKIGAFGLTEPNAGSDVAAMRTTAVRDGDSYILNGSKIWISLADVADHFLVFAYTDRSKKHHGITAFIVERGWEGFSTRSIKGKLGIRAGNTGELFFDHVRVPLENRLGEEGEGFKIAMSALDNGRFTVAAGACGCIAACLEASVKYCHERETFGQPIGKHQLVQQMIAKMAANLDISRLLVYRAGWLKNQGLPNTRETSLAKWVACDAAWEAASDAVQIHGAYGYSNEYPVERYLRNAKAPVIYEGTREIHTILQAEYALGYRRDKPLSRRLPAWPFEE

SEQ ID NO: 1168 - protein, 398 aa, Artificial
  Substituion in SEQ ID NO 1157
MMDFSLSQEQMAVRDVVRKFVDEEILPHIREWDEKQHFEPGVLRRLAELGLMGVCIPEKYGGAGMDYNTLAIVCEELERGDIAFRTAVSVHTGLNSLTLLQWGTEEQKQKYLVPQARGEKIGAFGLTEPNAGSDVAAMRTTAIRDGDSYILNGSKIWISLADVADHFLVFAYTDRSKKHHGITAFIVERGWEGFSTRSIKGKLGIRAGNTGELFFDHVRVPIENRLGEEGEGFKIAMSALDNGRFTVAAGACGCIAACLEASVKYCHERETFGQPIGKHQLVQQMIAKMAANLDISRLLVYRAGWLKNQGLPNTRETSLAKWVACDAAWEAASDAVQIHGAYGYSNEYPVERYLRNAKAPVIYEGTREIHTILQAEYALGYRRDKPLSRRLPAWPFEE

SEQ ID NO: 1169 - DNA, 1197 bp, Artificial
  Substituion in SEQ ID NO 1158
gtgatggatttcagcctgtcgcaagaacagatggcggttcgggacgtggtccgcaagttcgtggacgaggagatcttgccccacatccgcgagtgggacgagaaacagcattttgagccgggcgtgattaggcggctggcggagctggggctcatgggcgtgtgtatccccgagaagtacggcggcgcagggatggactacaacacgctcgccattgtctgtgaagagctcgaacggggagacatcgcgtttcgaacggccgtatcggtccacacaggactcaattctctcacgctgcttcagtgggggacggaggagcagaagcaaaagtatttggtgcctcaggcgcgcggtgagaagatcggggcgtttggactcaccgagccgaacgcggggtcggacgtggccgcgatgcggacgaccgccgtgcgggacggagattcgtatattttgaacgggtcgaagatctggatttcgctcgccgacgtcgcggaccacttcctggtctttgcgtacaccgatcgctcgaagaagcatcacgggatcacggcgttcatcgtggagcgcggctgggaagggttctcgacgagatcgatcaagggcaagctcggtattcgcgcaggcaacacgggggaactgttcttcgatcacgtccgcgtgccgatcgagaatcgacttggagaagagggcgaaggcttcaagattgccatgtccgccctcgacaacgggcggttcacggtggcggccggcgcgtgcggatgcatcgcggcttgcctcgaggcgtcggtcaagtactgccatgagcgcgagacgtttggccagcccatcggcaagcaccagctagtgcagcagatgattgcgaagatggccgcgaacctggacatctcccgcttgctggtctaccgggctgggtggctgaagaaccagggcttgccgaacacgcgcgaaacctcgctcgcgaagtgggtggcgtgtgatgcagcgtgggaggcggcgtcggacgcggttcagattcacggcgcctacgggtattcgaacgagtatccggtggagaggtacctgcgaaacgccaaggcacctgtgatctatgaggggacgcgcgagatccacaccatcctgcaggcggagtacgcgctcggataccggcgagacaaaccgctgtcgcgccgacttccggcgtggccgtttgaagaatga

SEQ ID NO: 1170 - DNA, 1197 bp, Artificial
  Substituion in SEQ ID NO 1158
gtgatggatttcagcctgtcgaatgaacagatggcggttcgggacgtggtccgcaagttcgtggacgaggagatcttgccccacatccgcgagtgggacgagaaacagcattttgagccgggcgtgctcaggcggctggcggagctggggctcatgggcgtgtgtatccccgagaagtacggcggcgcagggatggactacaacacgctcgccattgtctgtgaagagctcgaacggggagacatcgcgtttcgaacggccgtatcggtccacacaggactcaattctctcacgctgcttcagtgggggacggaggagcagaagcaaaagtatttggtgcctcaggcgcgcggtgagaagatcggggcgtttggactcaccgagccgaacgcggggtcggacgtggccgcgatgcggacgaccgccgtgcgggacggagattcgtatattttgaacgggtcgaagatctggatttcgctcgccgacgtcgcggaccacttcctggtctttgcgtacaccgatcgctcgaagaagcatcacgggatcacggcgttcatcgtggagcgcggctgggaagggttctcgacgagatcgatcaagggcaagctcggtattcgcgcaggcaacacgggggaactgttcttcgatcacgtccgcgtgccgatcgagaatcgacttggagaagagggcgaaggcttcaagattgccatgtccgccctcgacaacgggcggttcacggtggcggccggcgcgtgcggatgcatcgcggcttgcctcgaggcgtcggtcaagtactgccatgagcgcgagacgtttggccagcccatcggcaagcaccagctagtgcagcagatgattgcgaagatggccgcgaacctggacatctcccgcttgctggtctaccgggctgggtggctgaagaaccagggcttgccgaacacgcgcgaaacctcgctcgcgaagtgggtggcgtgtgatgcagcgtgggaggcggcgtcggacgcggttcagattcacggcgcctacgggtattcgaacgagtatccggtggagaggtacctgcgaaacgccaaggcacctgtgatctatgaggggacgcgcgagatccacaccatcctgcaggcggagtacgcgctcggataccggcgagacaaaccgctgtcgcgccgacttccggcgtggccgtttgaagaatga

SEQ ID NO: 1171 - DNA, 1197 bp, Artificial
  Substituion in SEQ ID NO 1158
gtgatggatttcagcctgtcgcaagaacagatggcggttcgggacgtggtccgcaagttcgtggacgaggagatcttgccccacatccgcgagtgggacgagaaacagcattttgagccgggcgtgctcaggcggctggcggagctggggctcatgggcgtgtgtatccccgagaagtacggcggcgcagggatggactacaacacgctcgccattgtctgtgaagagctcgaacggggagacatcgcgtttcgaacggccgtatcggtccacacaggactcaattctctcacgctgcttcagtgggggacggaggagcagaagcaaaagtatttggtgcctcaggcgcgcggtgagaagatcggggcgtttggactcaccgagccgaacgcggggtcggacgtggccgcgatgcggacgaccgccgtgcgggacggagattcgtatattttgaacgggtcgaagatctggatttcgctcgccgacgtcgcggaccacttcctggtctttgcgtacaccgatcgctcgaagaagcatcacgggatcacggcgttcatcgtggagcgcggctgggaagggttctcgacgagatcgatcaagggcaagctcggtattcgcgcaggcaacacgggggaactgttcttcgatcacgtccgcgtgccgatcgagaatcgacttggagaagagggcgaaggcttcaagattgccatgtccgccctcgacaacgggcggttcacggtggcggccggcgcgtgcggatgcatcgcggcttgcctcgaggcgtcggtcaagtactgccatgagcgcgagacgtttggccagcccatcggcaagcaccagctagtgcagcagatgattgcgaagatggccgcgaacctggacatctcccgcttgctggtctaccgggctgggtggctgaagaaccagggcttgccgcaaacgcgcgaaacctcgctcgcgaagtgggtggcgtgtgatgcagcgtgggaggcggcgtcggacgcggttcagattcacggcgcctacgggtattcgaacgagtatccggtggagaggtacctgcgaaacgccaaggcacctgtgatctatgaggggacgcgcgagatccacaccatcctgcaggcggagtacgcgctcggataccggcgagacaaaccgctgtcgcgccgacttccggcgtggccgtttgaagaatga

SEQ ID NO: 1172 - DNA, 1197 bp, Artificial
  Substituion in SEQ ID NO 1158
gtgatggatttcagcctgtcgcaagaacagatggcggttcgggacgtggtccgcaagttcgtggacgaggagatcttgccccacatccgcgagtgggacgagaaacagcattttgagccgggcgtgctcaggcggctggcggagctggggctcatgggcgtgtgtatccccgagaagtacggcggcgcagggatggactacaacacgctcgccattgtctgtgaagagctcgaacggggagacatcgcgtttcgaacggccgtatcggtccacacaggactcaattctctcacgctgcttcagtgggggacggaggagcagaagcaaaagtatttggtgcctcaggcgcgcggtgagaagatcggggcgtttggactcaccgagccgaacgcggggtcggacgtggccgcgatgcggacgaccgccgtgcgggacggagattcgtatattttgaacgggtcgaagatctggatttcgctcgccgacgtcgcggaccacttcctggtctttgcgtacaccgatcgctcgaagaagcatcacgggatcacggcgttcatcgtggagcgcggctgggaagggttctcgacgagatcgatcaagggcaagctcggtattcgcgcaggcaacacgggggaactgttcttcgatcacgtccgcgtgccgttagagaatcgacttggagaagagggcgaaggcttcaagattgccatgtccgccctcgacaacgggcggttcacggtggcggccggcgcgtgcggatgcatcgcggcttgcctcgaggcgtcggtcaagtactgccatgagcgcgagacgtttggccagcccatcggcaagcaccagctagtgcagcagatgattgcgaagatggccgcgaacctggacatctcccgcttgctggtctaccgggctgggtggctgaagaaccagggcttgccgaacacgcgcgaaacctcgctcgcgaagtgggtggcgtgtgatgcagcgtgggaggcggcgtcggacgcggttcagattcacggcgcctacgggtattcgaacgagtatccggtggagaggtacctgcgaaacgccaaggcacctgtgatctatgaggggacgcgcgagatccacaccatcctgcaggcggagtacgcgctcggataccggcgagacaaaccgctgtcgcgccgacttccggcgtggccgtttgaagaatga

SEQ ID NO: 1173 - DNA, 1197 bp, Artificial
  Substituion in SEQ ID NO 1158
gtgatggatttcagcctgtcgcaagaacagatggcggttcgggacgtggtccgcaagttcgtggacgaggagatcttgccccacatccgcgagtgggacgagaaacagcattttgagccgggcgtgctcaggcggctggcggagctggggctcatgggcgtgtgtatccccgagaagtacggcggcgcagggatggactacaacacgctcgccattgtctgtgaagagctcgaacggggagacatcgcgtttcgaacggccgtatcggtccacacaggactcaattctctcacgctgcttcagtgggggacggaggagcagaagcaaaagtatttggtgcctcaggcgcgcggtgagaagatcggggcgtttggactcaccgagccgaacgcggggtcggacgtggccgcgatgcggacgaccgccattcgggacggagattcgtatattttgaacgggtcgaagatctggatttcgctcgccgacgtcgcggaccacttcctggtctttgcgtacaccgatcgctcgaagaagcatcacgggatcacggcgttcatcgtggagcgcggctgggaagggttctcgacgagatcgatcaagggcaagctcggtattcgcgcaggcaacacgggggaactgttcttcgatcacgtccgcgtgccgatcgagaatcgacttggagaagagggcgaaggcttcaagattgccatgtccgccctcgacaacgggcggttcacggtggcggccggcgcgtgcggatgcatcgcggcttgcctcgaggcgtcggtcaagtactgccatgagcgcgagacgtttggccagcccatcggcaagcaccagctagtgcagcagatgattgcgaagatggccgcgaacctggacatctcccgcttgctggtctaccgggctgggtggctgaagaaccagggcttgccgaacacgcgcgaaacctcgctcgcgaagtgggtggcgtgtgatgcagcgtgggaggcggcgtcggacgcggttcagattcacggcgcctacgggtattcgaacgagtatccggtggagaggtacctgcgaaacgccaaggcacctgtgatctatgaggggacgcgcgagatccacaccatcctgcaggcggagtacgcgctcggataccggcgagacaaaccgctgtcgcgccgacttccggcgtggccgtttgaagaatga

SEQ ID NO: 1174 - protein, 680 aa, Alicyclobacillus acidocaldarius
MIVTQEITALQQLVDRSRRLGADRSICNWGGGNTSAKTTMLDHMGREIRVMWVKGSGSDLAEATEKSFTALRLDEVLPLMERDAMTDEEMVDYLAHCMVEAKHPRSSIETLLHAFIPHTHVDHTHPDSIIAICTSTNGREVAKEIFGDRAVWVPYLRPGFALSKLVAEAVRANPQCECVLMEKHGLITWGETSEACYANTVRIIGEAAEYLEAKQRGRVAFGGVKHPALPQEERRRIAVQILPFVRGIVSERQGAILSFDDSPEFLEFAGSHDAPSLSQVGAACPDHLVHTKRRPLFVDWSPSEGVDALKEKLKAGLTAYRDDYTAYYERNVDLDVPMHDPFPRILLIPGLGVIGTGKNKKMANIALDLYRRAIEVMRGATAIGEFVSLDEKESFDVEYWPLELYKLTLAPPEKELSRKVAYITGGAGGIGSATARRLAEEGAHVVIADLAADAARRLAEELCADHGPGTAIGVALDVTQEDAVVRSIEEAILAYGGIDLFVSNAGLASSAPVTETSLAEWNKNVAVLGTGYFLTSREAFRVMVEQGRGGAVVFVTSKNAVYAGKDASAYSAAKAMENHLARCLAVEGGPHGIRVNIVMPDAVLQGSNIWNSAWREERARAYGIAPEELEDYYRRRTILGVNILPEDIAEAILFFCSPRSAKTTGCMLTVDGGVAAAFPR

SEQ ID NO: 1175 - DNA, 2043 bp, Alicyclobacillus acidocaldarius
gtgatcgtcacacaggaaataaccgctctccagcaacttgtcgaccgatctcgccgcctcggcgcggatcgcagcatatgcaattggggtgggggaaacacgtccgccaagaccaccatgctcgatcacatgggccgcgagatccgcgtcatgtgggtgaaaggcagcggctccgacctcgccgaggcgacggagaagagcttcaccgcgctgcgtctggatgaggtgctgccgctcatggagcgcgacgcgatgacggacgaggagatggtcgactacctcgcgcactgcatggtagaggccaagcatccgcgatcgtccatcgagacactgctccacgccttcatcccgcacacgcatgtggatcacacgcacccggacagcatcatcgccatctgcacgagcacaaacgggcgcgaggtggcgaaggagatcttcggcgatcgcgccgtgtgggtcccgtatctgcggccggggttcgcgctgtccaagctggtcgcggaggccgtgcgggcgaacccccaatgcgagtgcgtgctgatggagaagcatggtctcatcacctggggcgaaacgtccgaagcatgctacgccaacaccgtgcgcatcattggtgaagctgcggagtacctcgaagcgaaacaacggggacgcgtggccttcggcggtgtgaaacatcccgcgctgccacaggaagaacggcgccgcatcgccgtgcagatcctgccgttcgtccgaggcatcgtgagcgagcgacaaggtgccattctctccttcgatgacagccccgagtttctcgagttcgccggcagccacgacgcgccgtcgctttcgcaggtcggtgccgcctgtccggatcacctcgttcataccaagcgccggccgctgtttgtggattggtccccttccgaaggcgtcgacgcgttgaaagaaaagctgaaggcggggcttacggcgtatcgcgacgactacacggcctattacgaacggaacgtcgacctcgacgtgcccatgcacgatccatttccacgcatcctcctcattccggggctcggcgtgattggcacaggcaagaacaagaagatggcgaacatcgcgctcgatctgtaccgcagagccatcgaggtcatgcgcggtgcgacggccatcggcgagtttgtgtcgctcgacgagaaggagtccttcgacgtcgaatattggccgctcgagctctataagctcacacttgcgccgccggagaaggaattgtcgcgaaaggtggcgtacatcaccggcggggccggcggcatcggcagcgcgaccgcccgccgtctggcggaggagggggcgcacgtcgtgatcgccgatctcgctgcggacgccgcccggcgcctggcggaggagctgtgtgccgatcacggccccggtacggccatcggcgtcgcgctcgacgtgacgcaggaagatgcggtcgttcgttccatcgaggaggccatcctggcttacggcgggatcgatctcttcgtctcaaacgcgggcctcgcgagctcggcgcctgtcaccgagacctcgctcgccgagtggaacaagaacgtcgcagtgctcggtacgggttacttcctgacgtcgcgagaggcgttccgcgtgatggtggagcaggggcgcggcggcgcggtggtctttgtgacgtccaaaaacgcggtttacgcagggaaggatgcatcggcgtacagcgccgcgaaggcgatggagaaccacctcgcgcgctgcttggccgtcgaaggcgggcctcacggcattcgggtgaacatcgtcatgccggacgcggttctccaaggatcgaacatttggaattcggcctggcgcgaggagcgcgcacgcgcgtacggcattgcgccggaggagcttgaagactactaccgcaggcgcaccattctcggcgtcaacatcctaccagaagacattgcggaggccatcctgttcttctgctcgccgagatcggccaaaacgaccgggtgcatgctcacggtggatggaggcgtcgccgccgcgtttccgcggtga

SEQ ID NO: 1176 - protein, 672 aa, Bacillus subtilis subsp. subtilis str. 168
VEELVYRSNLIGSDRTVCNWGGGNTSMKTTEKDFRGREIEVMWVKGSGSDLATMKAHNFSGLKLDDIRPLIKRDQMPDEEMVDYLSHCMIDSKHPRPSIETLLHAFLPYKHVDHTHPDAIISICCADNGKQIAEDIYGNRFVWVPYVRPGFTLSKMIAEGVANNPHAELVLMEKHGLVTWGETSETCYQKTISIIQEAEQYINDRINQHEVFGGKRYQPLPEDKRKQILAGIMPVIRGAVSEEKKMILSYDDHDDVLEFVNSVQAPALSQIGAACPDHLVHTKRVPLYIDWNPETQDVHKLADLIKSGVETFTSEYQAYFTRNQQDGDQIFESAPRVILIPGIGMVNTGKSYAMSKVSGALYRRAIAVMKGATALGQFVSLHENESYHVEYWPLELYKLTLAPPEAEFSRKVALITGGAGGIGSAACRRFAAEGGHVIVADLNIEGAQKIAGEINDAYGKGRAMAVKMDVTKEEDVQSAFERAALAYGGIDIVVNNAGLATSSPFDETSLKEWNLNMNVLGTGYFLVAREAFKQMKHQNRGGSMVFVGSKNSVYAGKNASAYSSVKALETHLARCIAAEGGEFGIRVNSVLPDAVLQGSAIWGSSWREERAAAYGIEPDQLEEHYRKRTALLVNIYPEDIAEAIAFFASSKAEKTTGCMITVDGGVPAAFTR

SEQ ID NO: 1177 - protein, 672 aa, Bacillus licheniformis ATCC 14580
LAELVYRSNLIGADRSVCNWGGGNTSMKTTEKDFRGRDIEVMWVKGSGSDLATMSAGQFTGLRLDDIRPLMERSSMTDEEMTAYLSHCMMDGKHPRPSIETLLHAFLPFPHVDHTHPDAIISICCCDNGKEIAEEIYGSRFVWVPYVRPGFALSKMIAEGVKNNPNAELVLMEKHGLVTWGETSKESYDQTIAVIREAEAYIKSRSEDHQPFGGQMVEPLAPEERKRILADILPVIRGAVSGEKRMLVTWCDADDVLEFANSRRAPSLSQVGAACPDHLVHTKRVPAYIPWNPAEQDTEALVDRIKTEIAGFKESYAAYFQRNRHEGDEMFEPAPRVMLIPGIGMVTAGKSLAMAKVSRDLYRRAIAVMKGTEVLGNFVSLNEEESYNVEYWPLELYKLTLAPPEAEFSRKIAFVTGGAGGIGSEACRRLALEGAHVVVADINIEGAEKTAAEINDQYGAERAYAVRMDVTKEEEVQTAFEEIALKYGGIDILVNNAGLATSSPLDETTLEEWNLNMNVLGTGYFLVAREAFKQMKKQGSGGSMVFVGSKNSVYAGKNASAYSSAKALEVHLARCIAAEGGPYGIRANSVLPDAVLQGSAIWDSKWREERAAAYGIEPDRLEEHYRKRTALSVNIYPADIAEAIAYFASEKTAKTTGCMLTVDGGVPAAFSR

SEQ ID NO: 1178 - protein, 673 aa, Bacillus clausii KSM-K16
LDELVYRSNLIGADRSVCNWGGGNTSMKTTEIDFRGNEVDVMWVKGSGSDLATMGANNFTGLRLDDVLPLKEREAMTDEEMVAYLGHCLIDPRHPRPSIETLLHAFLPFKHVDHTHPDAIISLCCAENGRELAEELFGDRFVWVPYIRPGFALSKMIAEQVDANPKAELVLMEKHGLVVWGETAKESYDRTISVINEAEQFIEKKRGKNAPFGGAATAGLKKEERQALLANIMPVLRGAVAHNGRNMIVTYDDSDPILEFVNSKEAKELSQIGAACPDHLVHTKRLPLFIDWVPDASDEEGLKQAVLNGIAAYKEDYIRYFERNRREGDTMFEPSPRVLLIPGIGLISSGKAVENAKVSRALYERAIAVMRGTNALGSFVSLNEAESYEIEYWPLELYKLSLAPKEATFSRKVAFVTGGAGGIGSETSRQFAAQGAHVVLADLNLERAEEVAAEINGQFGAGRALALKMDVTDEQAVKQAFADVARTYGGVDIVVNNAGLATSSPFDETTLQEWQLNLDVLATGYFLVARQAFAQMKEQGTGGSMVFIGSKNSVYAGKNASAYSAAKAMEAHLARCIAAEGGTYGIRVNTVLPDAVLQGSAIWDSAWREERAAAYGIAADELEDHYKKRTTLGVHIFPADIAEAVLFFASSKSEKTTGCMLTVDGGVPAAFPR

SEQ ID NO: 1179 - protein, 674 aa, Bacillus halodurans C-125
TGLDELVYRSNLIGSDRAVCNWGGGNTSMKTVEKDFRGREIAVMWVKGSGSDLATMGAKNFTGLNLEDIRPLIEREEMSDEEMVEYLGHCMIDRNHPRPSIETLLHAFLPFKHVDHTHPDAIISICCADNGKEIAKNLFGDRFVWVPYVRPGFSLSKLIAEGVQKNPHAELVLMEKHGLVVWGETAKESYDRTISVINEAEAYIRSRINESVIFGGGKYTALAKEERMSMLANVMPVIRGAVSDEKKMIVTFDDGDDVLEFVNSVDAARLSQVGAACPDHLVHTKMKPLFVKWDPSMNDINQLIAAIKDGISSFKEEYKSYFERNKNEGDVMFEPAPRVILIPGIGMVNTGKNVTMARVSGALYHRAIAVMKGATALGTFVSLNENESYNIEYWPLELYKLSLAPAEAEFSRKVAFVTGGAGGIGSETCRQFVAEGAHVVVADLNLEGAEKVVSEINEQYGTDRALAVKMDVTSEEQVQAAFKQASLTYGGIDIVVNNAGLATSSPFDETTLDEWNLNMNVLGTGYFLVAREAFKQMKVQGTGGNMVFIGSKNSVYAGKNATAYSSAKALETHLARCIAAEGGPFGIRVNSVLPDAVLQGSAIWGSRWRQERATAYGIEPDQLEEHYRKRTTLLVNVYPGDIAAAILFFASSKAEKTTGCMLTVDGGVPAAFTR

SEQ ID NO: 1180 - protein, 676 aa, Rubrobacter xylanophilus DSM 9941
LSPLEELAYRSNLLGSDRAVANYGGGNTSMKLRQEDHAGREIDVLWVKGSGSDLATIRPEQFTGLRLAEILPLMERDSMTDEEMVSYLARCQLAPDMPRSSIETLLHAFIPHPHVDHTHPDAVNMLCCAANGEELARECFGDEAVWIPYLRPGFDLSKKVAAAVRGNPRARFVLLAKHGLVTWGETAEESYARTVEAVNRAAEFVFRRASRTEAFGGRRLDPPPEEERRRLLAAVLPALRGELSSRGGPKILRADTSPDVTGFVCGRDSGELSQVGAACPDHLVHTKVRPLWVDFDPASEGVDALERRLREGVRRYRERYEEYFRRNRARVGRGDEQMHDPNPRVVLISGVGLVAAGRDLKAATLARDLYHRAISVIRGASSVDRFVSLDEEESYRVEYWPLELYKLTLAPPPKELAGRVALVTGGAGGIGSAVAERLHEAGACVVVADLDGEGASEVASRLGPEGLAVRADVTSEEEVARAFRAAALAYGGVDVVISNAGLASSAPLEETSLDLWRRNHAVLSEGYFLVSREAFALLKRQGIGGSIVFVGSKNALAAGRNAAAYSSAKAAELHLARCLAEEGGPHGIRVNTVNPDAVLQGSRIWDSAWREERARAYGIEPGELEEYYRNRTALKTNVYPEDVAEAVLHFASGRRSGKSTGNVLNVDGGVREAYPR

SEQ ID NO: 1181 - protein, 680 aa, Artificial
  Substituion in SEQ ID NO 1174
MIVTQEITALQQLVDRSRRLGADRSICNWGGGNTSAKTTMLDHMGREIRVMWVKGSGSDLAEATEKSFTALRLDEVLPLMERDAMTDEEMVDYLAHCMVEAKHPRSSIETLLHAFIPHTHVDHTHPDSIIAICTSTNGREVAKEIFGDRAVWVPYLRPGFALSKLVADAVRANPQCECVLMEKHGLITWGETSEACYANTVRIIGEAAEYLEAKQRGRVAFGGVKHPALPQEERRRIAVQILPFVRGIVSERQGAILSFDDSPEFLEFAGSHDAPSLSQVGAACPDHLVHTKRRPLFVDWSPSEGVDALKEKLKAGLTAYRDDYTAYYERNVDLDVPMHDPFPRILLIPGLGVIGTGKNKKMANIALDLYRRAIEVMRGATAIGEFVSLDEKESFDVEYWPLELYKLTLAPPEKELSRKVAYITGGAGGIGSATARRLAEEGAHVVIADLAADAARRLAEELCADHGPGTAIGVALDVTQEDAVVRSIEEAILAYGGIDLFVSNAGLASSAPVTETSLAEWNKNVAVLGTGYFLTSREAFRVMVEQGRGGAVVFVTSKNAVYAGKDASAYSAAKAMENHLARCLAVEGGPHGIRVNIVMPDAVLQGSNIWNSAWREERARAYGIAPEELEDYYRRRTILGVNILPEDIAEAILFFCSPRSAKTTGCMLTVDGGVAAAFPR

SEQ ID NO: 1182 - protein, 680 aa, Artificial
  Substituion in SEQ ID NO 1174
MIVTQEITALQQLVDRSRRLGADRSICNWGGGNTSAKTTMLDHMGREIRVMWVKGSGSDLAEATEKSFTALRLDEVLPLMERDAMTDEEMVDYLAHCMVEAKHPRSSIETLLHAFIPHTHVDHTHPDSIIAICTSTNGREVAKEIFGDRAVWVPYLRPGFALSKLVAEAVRANPQCECVLMEKHGLITWGETSEACYANTVRIIGEAAEYLEAKQRGRVAFGGVKHPALPQEERRRIAVQILPFVRGIVSERQGAILSFDDSPEFLEFAGSHDAPSLSQVGAACPDHLVHTKRRPLFVDWSPSEGVDALKEKLKAGLTAYRDDYTAYYERNVDLDVPMHDPFPRILLIPGLGVIGTGKNKKMAQIALDLYRRAIEVMRGATAIGEFVSLDEKESFDVEYWPLELYKLTLAPPEKELSRKVAYITGGAGGIGSATARRLAEEGAHVVIADLAADAARRLAEELCADHGPGTAIGVALDVTQEDAVVRSIEEAILAYGGIDLFVSNAGLASSAPVTETSLAEWNKNVAVLGTGYFLTSREAFRVMVEQGRGGAVVFVTSKNAVYAGKDASAYSAAKAMENHLARCLAVEGGPHGIRVNIVMPDAVLQGSNIWNSAWREERARAYGIAPEELEDYYRRRTILGVNILPEDIAEAILFFCSPRSAKTTGCMLTVDGGVAAAFPR

SEQ ID NO: 1183 - protein, 680 aa, Artificial
  Substituion in SEQ ID NO 1174
MIVTQEITALQQLVDRSRRLGADRSICNWGGGNTSAKTTMLDHMGREIRVMWVKGSGSDLAEATEKSFTALRLDEVLPLMERDAMTDEEMVDYLAHCMVEAKHPRSSIETLLHAFIPHTHVDHTHPDSIIAICTSTNGREVAKEIFGDRAVWVPYLRPGFALSKLVAEAVRANPQCECVLMEKHGLITWGETSEACYANTVRIIGEAAEYLEAKQRGRVAFGGVKHPALPQEERRRIAVQILPFVRGIVSERQGAILSFDDSPEFLEFAGSHDAPSLSQVGAACPDHLVHTKRRPLFVDWSPSEGVDALKEKLKAGLTAYRDDYTAYYERNVDLDVPMHDPFPRILLIPGLGVIGTGKNKKMANIALDLYRRAIEVMRGATAIGEFVSLDEKESFDVEYWPLELYKLTLAPPEKELSRKVAYITGGAGGIGSATARRLAEEGAHVVIADLAADAARRLADELCADHGPGTAIGVALDVTQEDAVVRSIEEAILAYGGIDLFVSNAGLASSAPVTETSLAEWNKNVAVLGTGYFLTSREAFRVMVEQGRGGAVVFVTSKNAVYAGKDASAYSAAKAMENHLARCLAVEGGPHGIRVNIVMPDAVLQGSNIWNSAWREERARAYGIAPEELEDYYRRRTILGVNILPEDIAEAILFFCSPRSAKTTGCMLTVDGGVAAAFPR

SEQ ID NO: 1184 - protein, 680 aa, Artificial
  Substituion in SEQ ID NO 1174
MIVTQEITALQQLVDRSRRLGADRSICNWGGGNTSAKTTMLDHMGREIRVMWVKGSGSDLAEATEKSFTALRLDEVLPLMERDAMTDEEMVDYLAHCMVEAKHPRSSIETLLHAFIPHTHVDHTHPDSIIAICTSTNGREVAKEIFGDRAVWVPYLRPGFALSKLVAEAVRANPQCECVLMEKHGLITWGETSEACYANTVRIIGEAAEYLEAKQRGRVAFGGVKHPALPQEERRRIAVQILPFVRGIVSERQGAILSFDDSPEFLEFAGSHDAPSLSQVGAACPDHLVHTKRRPLFVDWSPSEGVDALKEKLKAGLTAYRDDYTAYYERNVDLDVPMHDPFPRILLIPGLGVIGTGKNKKMANIALDLYRRAIEVMRGATAIGEFVSLDEKESFDVEYWPLELYKLTLAPPEKELSRKVAYITGGAGGIGSATARRLAEEGAHVVIADLAADAARRLAEELCAEHGPGTAIGVALDVTQEDAVVRSIEEAILAYGGIDLFVSNAGLASSAPVTETSLAEWNKNVAVLGTGYFLTSREAFRVMVEQGRGGAVVFVTSKNAVYAGKDASAYSAAKAMENHLARCLAVEGGPHGIRVNIVMPDAVLQGSNIWNSAWREERARAYGIAPEELEDYYRRRTILGVNILPEDIAEAILFFCSPRSAKTTGCMLTVDGGVAAAFPR

SEQ ID NO: 1185 - protein, 680 aa, Artificial
  Substituion in SEQ ID NO 1174
MIVTQEITALQQLVDRSRRLGADRSICNWGGGNTSAKTTMLDHMGREIRVMWVKGSGSDLAEATEKSFTALRLDEVLPLMERDAMTDEEMVEYLAHCMVEAKHPRSSIETLLHAFIPHTHVDHTHPDSIIAICTSTNGREVAKEIFGDRAVWVPYLRPGFALSKLVAEAVRANPQCECVLMEKHGLITWGETSEACYANTVRIIGEAAEYLEAKQRGRVAFGGVKHPALPQEERRRIAVQILPFVRGIVSERQGAILSFDDSPEFLEFAGSHDAPSLSQVGAACPDHLVHTKRRPLFVDWSPSEGVDALKEKLKAGLTAYRDDYTAYYERNVDLDVPMHDPFPRILLIPGLGVIGTGKNKKMANIALDLYRRAIEVMRGATAIGEFVSLDEKESFDVEYWPLELYKLTLAPPEKELSRKVAYITGGAGGIGSATARRLAEEGAHVVIADLAADAARRLAEELCADHGPGTAIGVALDVTQEDAVVRSIEEAILAYGGIDLFVSNAGLASSAPVTETSLAEWNKNVAVLGTGYFLTSREAFRVMVEQGRGGAVVFVTSKNAVYAGKDASAYSAAKAMENHLARCLAVEGGPHGIRVNIVMPDAVLQGSNIWNSAWREERARAYGIAPEELEDYYRRRTILGVNILPEDIAEAILFFCSPRSAKTTGCMLTVDGGVAAAFPR

SEQ ID NO: 1186 - DNA, 2043 bp, Artificial
  Substituion in SEQ ID NO 1175
gtgatcgtcacacaggaaataaccgctctccagcaacttgtcgaccgatctcgccgcctcggcgcggatcgcagcatatgcaattggggtgggggaaacacgtccgccaagaccaccatgctcgatcacatgggccgcgagatccgcgtcatgtgggtgaaaggcagcggctccgacctcgccgaggcgacggagaagagcttcaccgcgctgcgtctggatgaggtgctgccgctcatggagcgcgacgcgatgacggacgaggagatggtcgactacctcgcgcactgcatggtagaggccaagcatccgcgatcgtccatcgagacactgctccacgccttcatcccgcacacgcatgtggatcacacgcacccggacagcatcatcgccatctgcacgagcacaaacgggcgcgaggtggcgaaggagatcttcggcgatcgcgccgtgtgggtcccgtatctgcggccggggttcgcgctgtccaagctggtcgcggatgccgtgcgggcgaacccccaatgcgagtgcgtgctgatggagaagcatggtctcatcacctggggcgaaacgtccgaagcatgctacgccaacaccgtgcgcatcattggtgaagctgcggagtacctcgaagcgaaacaacggggacgcgtggccttcggcggtgtgaaacatcccgcgctgccacaggaagaacggcgccgcatcgccgtgcagatcctgccgttcgtccgaggcatcgtgagcgagcgacaaggtgccattctctccttcgatgacagccccgagtttctcgagttcgccggcagccacgacgcgccgtcgctttcgcaggtcggtgccgcctgtccggatcacctcgttcataccaagcgccggccgctgtttgtggattggtccccttccgaaggcgtcgacgcgttgaaagaaaagctgaaggcggggcttacggcgtatcgcgacgactacacggcctattacgaacggaacgtcgacctcgacgtgcccatgcacgatccatttccacgcatcctcctcattccggggctcggcgtgattggcacaggcaagaacaagaagatggcgaacatcgcgctcgatctgtaccgcagagccatcgaggtcatgcgcggtgcgacggccatcggcgagtttgtgtcgctcgacgagaaggagtccttcgacgtcgaatattggccgctcgagctctataagctcacacttgcgccgccggagaaggaattgtcgcgaaaggtggcgtacatcaccggcggggccggcggcatcggcagcgcgaccgcccgccgtctggcggaggagggggcgcacgtcgtgatcgccgatctcgctgcggacgccgcccggcgcctggcggaggagctgtgtgccgatcacggccccggtacggccatcggcgtcgcgctcgacgtgacgcaggaagatgcggtcgttcgttccatcgaggaggccatcctggcttacggcgggatcgatctcttcgtctcaaacgcgggcctcgcgagctcggcgcctgtcaccgagacctcgctcgccgagtggaacaagaacgtcgcagtgctcggtacgggttacttcctgacgtcgcgagaggcgttccgcgtgatggtggagcaggggcgcggcggcgcggtggtctttgtgacgtccaaaaacgcggtttacgcagggaaggatgcatcggcgtacagcgccgcgaaggcgatggagaaccacctcgcgcgctgcttggccgtcgaaggcgggcctcacggcattcgggtgaacatcgtcatgccggacgcggttctccaaggatcgaacatttggaattcggcctggcgcgaggagcgcgcacgcgcgtacggcattgcgccggaggagcttgaagactactaccgcaggcgcaccattctcggcgtcaacatcctaccagaagacattgcggaggccatcctgttcttctgctcgccgagatcggccaaaacgaccgggtgcatgctcacggtggatggaggcgtcgccgccgcgtttccgcggtga

SEQ ID NO: 1187 - DNA, 2043 bp, Artificial
  Substituion in SEQ ID NO 1175
gtgatcgtcacacaggaaataaccgctctccagcaacttgtcgaccgatctcgccgcctcggcgcggatcgcagcatatgcaattggggtgggggaaacacgtccgccaagaccaccatgctcgatcacatgggccgcgagatccgcgtcatgtgggtgaaaggcagcggctccgacctcgccgaggcgacggagaagagcttcaccgcgctgcgtctggatgaggtgctgccgctcatggagcgcgacgcgatgacggacgaggagatggtcgactacctcgcgcactgcatggtagaggccaagcatccgcgatcgtccatcgagacactgctccacgccttcatcccgcacacgcatgtggatcacacgcacccggacagcatcatcgccatctgcacgagcacaaacgggcgcgaggtggcgaaggagatcttcggcgatcgcgccgtgtgggtcccgtatctgcggccggggttcgcgctgtccaagctggtcgcggaggccgtgcgggcgaacccccaatgcgagtgcgtgctgatggagaagcatggtctcatcacctggggcgaaacgtccgaagcatgctacgccaacaccgtgcgcatcattggtgaagctgcggagtacctcgaagcgaaacaacggggacgcgtggccttcggcggtgtgaaacatcccgcgctgccacaggaagaacggcgccgcatcgccgtgcagatcctgccgttcgtccgaggcatcgtgagcgagcgacaaggtgccattctctccttcgatgacagccccgagtttctcgagttcgccggcagccacgacgcgccgtcgctttcgcaggtcggtgccgcctgtccggatcacctcgttcataccaagcgccggccgctgtttgtggattggtccccttccgaaggcgtcgacgcgttgaaagaaaagctgaaggcggggcttacggcgtatcgcgacgactacacggcctattacgaacggaacgtcgacctcgacgtgcccatgcacgatccatttccacgcatcctcctcattccggggctcggcgtgattggcacaggcaagaacaagaagatggcgcaaatcgcgctcgatctgtaccgcagagccatcgaggtcatgcgcggtgcgacggccatcggcgagtttgtgtcgctcgacgagaaggagtccttcgacgtcgaatattggccgctcgagctctataagctcacacttgcgccgccggagaaggaattgtcgcgaaaggtggcgtacatcaccggcggggccggcggcatcggcagcgcgaccgcccgccgtctggcggaggagggggcgcacgtcgtgatcgccgatctcgctgcggacgccgcccggcgcctggcggaggagctgtgtgccgatcacggccccggtacggccatcggcgtcgcgctcgacgtgacgcaggaagatgcggtcgttcgttccatcgaggaggccatcctggcttacggcgggatcgatctcttcgtctcaaacgcgggcctcgcgagctcggcgcctgtcaccgagacctcgctcgccgagtggaacaagaacgtcgcagtgctcggtacgggttacttcctgacgtcgcgagaggcgttccgcgtgatggtggagcaggggcgcggcggcgcggtggtctttgtgacgtccaaaaacgcggtttacgcagggaaggatgcatcggcgtacagcgccgcgaaggcgatggagaaccacctcgcgcgctgcttggccgtcgaaggcgggcctcacggcattcgggtgaacatcgtcatgccggacgcggttctccaaggatcgaacatttggaattcggcctggcgcgaggagcgcgcacgcgcgtacggcattgcgccggaggagcttgaagactactaccgcaggcgcaccattctcggcgtcaacatcctaccagaagacattgcggaggccatcctgttcttctgctcgccgagatcggccaaaacgaccgggtgcatgctcacggtggatggaggcgtcgccgccgcgtttccgcggtga

SEQ ID NO: 1188 - DNA, 2043 bp, Artificial
  Substituion in SEQ ID NO 1175
gtgatcgtcacacaggaaataaccgctctccagcaacttgtcgaccgatctcgccgcctcggcgcggatcgcagcatatgcaattggggtgggggaaacacgtccgccaagaccaccatgctcgatcacatgggccgcgagatccgcgtcatgtgggtgaaaggcagcggctccgacctcgccgaggcgacggagaagagcttcaccgcgctgcgtctggatgaggtgctgccgctcatggagcgcgacgcgatgacggacgaggagatggtcgactacctcgcgcactgcatggtagaggccaagcatccgcgatcgtccatcgagacactgctccacgccttcatcccgcacacgcatgtggatcacacgcacccggacagcatcatcgccatctgcacgagcacaaacgggcgcgaggtggcgaaggagatcttcggcgatcgcgccgtgtgggtcccgtatctgcggccggggttcgcgctgtccaagctggtcgcggaggccgtgcgggcgaacccccaatgcgagtgcgtgctgatggagaagcatggtctcatcacctggggcgaaacgtccgaagcatgctacgccaacaccgtgcgcatcattggtgaagctgcggagtacctcgaagcgaaacaacggggacgcgtggccttcggcggtgtgaaacatcccgcgctgccacaggaagaacggcgccgcatcgccgtgcagatcctgccgttcgtccgaggcatcgtgagcgagcgacaaggtgccattctctccttcgatgacagccccgagtttctcgagttcgccggcagccacgacgcgccgtcgctttcgcaggtcggtgccgcctgtccggatcacctcgttcataccaagcgccggccgctgtttgtggattggtccccttccgaaggcgtcgacgcgttgaaagaaaagctgaaggcggggcttacggcgtatcgcgacgactacacggcctattacgaacggaacgtcgacctcgacgtgcccatgcacgatccatttccacgcatcctcctcattccggggctcggcgtgattggcacaggcaagaacaagaagatggcgaacatcgcgctcgatctgtaccgcagagccatcgaggtcatgcgcggtgcgacggccatcggcgagtttgtgtcgctcgacgagaaggagtccttcgacgtcgaatattggccgctcgagctctataagctcacacttgcgccgccggagaaggaattgtcgcgaaaggtggcgtacatcaccggcggggccggcggcatcggcagcgcgaccgcccgccgtctggcggaggagggggcgcacgtcgtgatcgccgatctcgctgcggacgccgcccggcgcctggcggatgagctgtgtgccgatcacggccccggtacggccatcggcgtcgcgctcgacgtgacgcaggaagatgcggtcgttcgttccatcgaggaggccatcctggcttacggcgggatcgatctcttcgtctcaaacgcgggcctcgcgagctcggcgcctgtcaccgagacctcgctcgccgagtggaacaagaacgtcgcagtgctcggtacgggttacttcctgacgtcgcgagaggcgttccgcgtgatggtggagcaggggcgcggcggcgcggtggtctttgtgacgtccaaaaacgcggtttacgcagggaaggatgcatcggcgtacagcgccgcgaaggcgatggagaaccacctcgcgcgctgcttggccgtcgaaggcgggcctcacggcattcgggtgaacatcgtcatgccggacgcggttctccaaggatcgaacatttggaattcggcctggcgcgaggagcgcgcacgcgcgtacggcattgcgccggaggagcttgaagactactaccgcaggcgcaccattctcggcgtcaacatcctaccagaagacattgcggaggccatcctgttcttctgctcgccgagatcggccaaaacgaccgggtgcatgctcacggtggatggaggcgtcgccgccgcgtttccgcggtga

SEQ ID NO: 1189 - DNA, 2043 bp, Artificial
  Substituion in SEQ ID NO 1175
gtgatcgtcacacaggaaataaccgctctccagcaacttgtcgaccgatctcgccgcctcggcgcggatcgcagcatatgcaattggggtgggggaaacacgtccgccaagaccaccatgctcgatcacatgggccgcgagatccgcgtcatgtgggtgaaaggcagcggctccgacctcgccgaggcgacggagaagagcttcaccgcgctgcgtctggatgaggtgctgccgctcatggagcgcgacgcgatgacggacgaggagatggtcgactacctcgcgcactgcatggtagaggccaagcatccgcgatcgtccatcgagacactgctccacgccttcatcccgcacacgcatgtggatcacacgcacccggacagcatcatcgccatctgcacgagcacaaacgggcgcgaggtggcgaaggagatcttcggcgatcgcgccgtgtgggtcccgtatctgcggccggggttcgcgctgtccaagctggtcgcggaggccgtgcgggcgaacccccaatgcgagtgcgtgctgatggagaagcatggtctcatcacctggggcgaaacgtccgaagcatgctacgccaacaccgtgcgcatcattggtgaagctgcggagtacctcgaagcgaaacaacggggacgcgtggccttcggcggtgtgaaacatcccgcgctgccacaggaagaacggcgccgcatcgccgtgcagatcctgccgttcgtccgaggcatcgtgagcgagcgacaaggtgccattctctccttcgatgacagccccgagtttctcgagttcgccggcagccacgacgcgccgtcgctttcgcaggtcggtgccgcctgtccggatcacctcgttcataccaagcgccggccgctgtttgtggattggtccccttccgaaggcgtcgacgcgttgaaagaaaagctgaaggcggggcttacggcgtatcgcgacgactacacggcctattacgaacggaacgtcgacctcgacgtgcccatgcacgatccatttccacgcatcctcctcattccggggctcggcgtgattggcacaggcaagaacaagaagatggcgaacatcgcgctcgatctgtaccgcagagccatcgaggtcatgcgcggtgcgacggccatcggcgagtttgtgtcgctcgacgagaaggagtccttcgacgtcgaatattggccgctcgagctctataagctcacacttgcgccgccggagaaggaattgtcgcgaaaggtggcgtacatcaccggcggggccggcggcatcggcagcgcgaccgcccgccgtctggcggaggagggggcgcacgtcgtgatcgccgatctcgctgcggacgccgcccggcgcctggcggaggagctgtgtgccgaacacggccccggtacggccatcggcgtcgcgctcgacgtgacgcaggaagatgcggtcgttcgttccatcgaggaggccatcctggcttacggcgggatcgatctcttcgtctcaaacgcgggcctcgcgagctcggcgcctgtcaccgagacctcgctcgccgagtggaacaagaacgtcgcagtgctcggtacgggttacttcctgacgtcgcgagaggcgttccgcgtgatggtggagcaggggcgcggcggcgcggtggtctttgtgacgtccaaaaacgcggtttacgcagggaaggatgcatcggcgtacagcgccgcgaaggcgatggagaaccacctcgcgcgctgcttggccgtcgaaggcgggcctcacggcattcgggtgaacatcgtcatgccggacgcggttctccaaggatcgaacatttggaattcggcctggcgcgaggagcgcgcacgcgcgtacggcattgcgccggaggagcttgaagactactaccgcaggcgcaccattctcggcgtcaacatcctaccagaagacattgcggaggccatcctgttcttctgctcgccgagatcggccaaaacgaccgggtgcatgctcacggtggatggaggcgtcgccgccgcgtttccgcggtga

SEQ ID NO: 1190 - DNA, 2043 bp, Artificial
  Substituion in SEQ ID NO 1175
gtgatcgtcacacaggaaataaccgctctccagcaacttgtcgaccgatctcgccgcctcggcgcggatcgcagcatatgcaattggggtgggggaaacacgtccgccaagaccaccatgctcgatcacatgggccgcgagatccgcgtcatgtgggtgaaaggcagcggctccgacctcgccgaggcgacggagaagagcttcaccgcgctgcgtctggatgaggtgctgccgctcatggagcgcgacgcgatgacggacgaggagatggtcgaatacctcgcgcactgcatggtagaggccaagcatccgcgatcgtccatcgagacactgctccacgccttcatcccgcacacgcatgtggatcacacgcacccggacagcatcatcgccatctgcacgagcacaaacgggcgcgaggtggcgaaggagatcttcggcgatcgcgccgtgtgggtcccgtatctgcggccggggttcgcgctgtccaagctggtcgcggaggccgtgcgggcgaacccccaatgcgagtgcgtgctgatggagaagcatggtctcatcacctggggcgaaacgtccgaagcatgctacgccaacaccgtgcgcatcattggtgaagctgcggagtacctcgaagcgaaacaacggggacgcgtggccttcggcggtgtgaaacatcccgcgctgccacaggaagaacggcgccgcatcgccgtgcagatcctgccgttcgtccgaggcatcgtgagcgagcgacaaggtgccattctctccttcgatgacagccccgagtttctcgagttcgccggcagccacgacgcgccgtcgctttcgcaggtcggtgccgcctgtccggatcacctcgttcataccaagcgccggccgctgtttgtggattggtccccttccgaaggcgtcgacgcgttgaaagaaaagctgaaggcggggcttacggcgtatcgcgacgactacacggcctattacgaacggaacgtcgacctcgacgtgcccatgcacgatccatttccacgcatcctcctcattccggggctcggcgtgattggcacaggcaagaacaagaagatggcgaacatcgcgctcgatctgtaccgcagagccatcgaggtcatgcgcggtgcgacggccatcggcgagtttgtgtcgctcgacgagaaggagtccttcgacgtcgaatattggccgctcgagctctataagctcacacttgcgccgccggagaaggaattgtcgcgaaaggtggcgtacatcaccggcggggccggcggcatcggcagcgcgaccgcccgccgtctggcggaggagggggcgcacgtcgtgatcgccgatctcgctgcggacgccgcccggcgcctggcggaggagctgtgtgccgatcacggccccggtacggccatcggcgtcgcgctcgacgtgacgcaggaagatgcggtcgttcgttccatcgaggaggccatcctggcttacggcgggatcgatctcttcgtctcaaacgcgggcctcgcgagctcggcgcctgtcaccgagacctcgctcgccgagtggaacaagaacgtcgcagtgctcggtacgggttacttcctgacgtcgcgagaggcgttccgcgtgatggtggagcaggggcgcggcggcgcggtggtctttgtgacgtccaaaaacgcggtttacgcagggaaggatgcatcggcgtacagcgccgcgaaggcgatggagaaccacctcgcgcgctgcttggccgtcgaaggcgggcctcacggcattcgggtgaacatcgtcatgccggacgcggttctccaaggatcgaacatttggaattcggcctggcgcgaggagcgcgcacgcgcgtacggcattgcgccggaggagcttgaagactactaccgcaggcgcaccattctcggcgtcaacatcctaccagaagacattgcggaggccatcctgttcttctgctcgccgagatcggccaaaacgaccgggtgcatgctcacggtggatggaggcgtcgccgccgcgtttccgcggtga

SEQ ID NO: 1191 - protein, 383 aa, Alicyclobacillus acidocaldarius
MFSYSIQTHIEFGDGAVEHLPEHLVARGFGRRLLIVTDPGLVRAGVADRIAGLLSRAGFVPRVFAEVRPNPDETVCLAGRGAFFEHRADGVVAVGGGSSLDAGKAIALLARQGGTPSDYALNRRPYGPPAPVCAVPTTAGTGSEVTRSAVITERGTHRKLTLKHEYLRPPLAVCDPTLTASLPPDVTAHTGVDALVHAIEGSTCKGAHPIARAYAREALGLIYRALPKAIKAGDPASRHDMLLGSLLAGLAFGSTDVASVHCLAEALGSLYETPHGLANAVMLLPTLRYNLPCAVEPYAWIARAMGLAREEDGAERAAEALLAGLRTWLESLDIPKLRDLPGVRPSDFDRLAELAYENTSTPSNPRPMAVSDYRAVLEMAYAD

SEQ ID NO: 1192 - DNA, 1152 bp, Alicyclobacillus acidocaldarius
atgttctcctactccattcagacgcacatcgaatttggcgacggtgccgtcgaacaccttcccgagcacctcgtggcgcgagggtttgggcggcggctgctcatcgtgacggatccggggctggtgcgggccggtgtggcggatcgcatcgcgggccttctctctcgcgcgggctttgtgccccgggtgttcgccgaggttcgacccaatccggacgaaaccgtctgcctcgcaggtcgaggcgccttcttcgagcaccgcgcagacggcgtcgtggccgtgggcggcggcagcagcctggacgcgggcaaggccatcgcgctcctcgcgcgccagggcggcacgccgagcgactacgcgctcaacagacggccatacggtccgcctgcgcccgtctgcgccgtgcccaccaccgctgggacgggatcggaggtgacgagatcggccgtcatcacggaacgcgggacacaccgaaagctcaccctgaagcacgagtacctgcgcccacccctcgctgtgtgcgatccgaccctgaccgcaagcctcccgcccgacgtgacggctcacaccggcgtcgacgcgctcgtgcacgccattgaagggtcgacgtgcaagggagcgcaccccatcgcgcgggcctacgcgcgggaggcgctcggcctcatctaccgcgccctcccgaaggccatcaaggcaggcgatccggcctcgcggcacgacatgctgctcggcagcctgctcgcgggtctcgcgttcggatcgacggatgtggcctccgtgcactgcttggccgaggccctgggcagtctgtacgaaacgccgcacgggttggcgaacgcggtgatgcttttgccgacgcttcgttacaacctcccctgcgcggtggagccgtacgcctggatcgcgcgggccatggggctggcgcgcgaggaagatggcgccgagcgcgcggcggaagcgctccttgcggggcttcggacttggctcgagagcctcgacatcccgaaactgcgggatctgccgggcgtgaggccgtcggacttcgaccggttggcggagctcgcgtacgagaacacctcgacgccgagcaatccgcgcccgatggcggtgagcgactaccgcgcggtgctcgagatggcctatgcagactga

SEQ ID NO: 1193 - protein, 382 aa, Bacillus pumilus SAFR-032
FEYHCQTNIMMGNGQSKEIGSIVEDLVLPGAKVMIVTDSGVRNAGLVQPIEAYLQEAGYSVFVFDQVSPNPRDNECLAGAELFRKEQASAVIAIGGGSPMDTAKAIALLGPNGGIPEDYKSGKKAYANLSPLICIPTTAGTGSEVTRSSVITLAASHKKITLKHALLRPTIAILDPALTLTVPKSITAATGVDALVHAIEGYSCKVTNPISKAMGASAMETIVKYLPAAYKDGSDLEARYKMQEGSLLAGLCFGSADVAAVHCLAEALGSLYDTPHGIANAVFLPYVMQFNAAENKVLHAELAKIMSFADKTDSDDVAIQKLIDGMYTFTKNLGIPVLKDLSYVKEEDFEKMAELAEQNGSTSSNVRTVTKADYLDILKAAF

SEQ ID NO: 1194 - protein, 379 aa, Clostridium bartlettii DSM 16795
LFSFELPTKIIYGANCLDNLCVELKENKGKKPIIITDKGVENAGILKKITDLLDKDDFPYVIYAGVEANPKDVNVEEGAKIARENDCDCIIAVGGGSPIDCAKSVGVLLAHNDTEIKKYEGKTAATKPLPLFITIPTTSGTGSEITFSSVITDTKNKYKMTVKSKYTAAKVAICDPVLTLSVPPAVTAATGMDALTHAIEAYTATCSEPIADAVSLYAIELIYNNLKTAVFEGDNLQARSAMLMGSMLAGIGFSHSDVASVHCISEALGGMFDLSHGVCNAVLLPHVMEYNKDYCVAKYARVAKAMGFEFKSDDEGADLAVKAVQQLALDVKLPLFSELNVEPKDFDILADKSAINISTESNPRPMSKEDYLNVLNNAY

SEQ ID NO: 1195 - protein, 378 aa, Actinobacillus succinogenes 130Z
YFLPTRNVFGENAVEEVGTLMKSLGGNNPLIVTDAFLAKNGMADQLAAVLSNAGLKPVIFGGAEPNPTDKNVEEGIVFYNEHGCDSIISLGGGSSHDCAKGIGLIASNGGRIQDYEGVDRSHNAMVPLMAVNTTAGTASEITRFCIITDTARKVKMAIVDWRITPQIAVNDPLLMKGMPPSLTAATGMDALTHAIEAYVSTAANPLTDAAALMAITMIQQYLPKAVANGDYMKARDKMAYAQYLAGIAFNNASLGYVHAMAHQLGGFYNLPHGVCNAILLPYVEEFNLIGNLNRFRDIAKAMGENIDGLCTDDAALKAIGAIRRLSKQVGIPANLQLLGVKPEDFDVMAENAMKDVCMLTNPRKATKQQVIEIFQRAY

SEQ ID NO: 1196 - protein, 379 aa, Pseudomonas putida KT2440
FKFLLPSKIVMEPGLRERTGEHLRQLGLARVLIVTDAGVKAAGLLDSVYASLDKAGIAYEEVADIKANPRSDDINHTAQRYRGTGIDGLLAVGGGSAMDAAKAISLLLTHDGRIEDYEGSFTLTHAIPPIVAIPTTAGTGSEVTCFSVITDTARHFKMNVLDYRIGPVLALLDSHITDTLPPSIAAATGMDALTHAIEAYTCRVANPISDGLALHAIRLISQHLKAAVQEPDNQAAREQMLVASLIAGMAFGNADVGSVHCISEAIGGMYDTPHGVGNAIFLPFVFGHNRDADIVRHAQVAYALGIDPTLSPVDAAEAAVGHLFQMSKDLGIPRFAEVKGVREEDFPTIAEKSKQNFSDASNAKAMSVEAYHDIITTAY

SEQ ID NO: 1197 - protein, 376 aa, Myxococcus xanthus DK 1622
TRIVFGAGALLRLPAQAQRLGIQRPLLVTDAGVVKAGLAARVADVLNTAGLACEVFDRVEPNPTERDVFAGLEAYRSHSCDGIVALGGGSALDAGKLIQLLTTHEPPLSRYDDAKGGDQYVRDDLPPLIAIPTTAGTGSEVGRSGVVTLEDTGRKTVIFSPYLLPRAAICDPELTLGLPPGITAATGMDAFTHCLEAYLANGFHPLADAVAIDGIYRVGRSLETAVRDGKDLAARTDMMVAAMEGAMAFQKGLGACHALAHALTPVSNVHHGLANAIVLPVVMEFNRAVCTARLARVAVALGDTTQAREEVLAGNAIDRVRKLNAAVGIPSRLRDAGVQEKDLERIAEKAFQDASHLSNPRKVSQADLLALAREAY

SEQ ID NO: 1198 - protein, 383 aa, Artificial
  Substituion in SEQ ID NO 1191
MFSYSIQTHIEFGDGAVEHLPEHLVARGFGRRLLIVTDPGLVRAGVADRIAGLLSRAGFVPRVFAEVRPNPDETVCLAGRGAFFEHRADGVVAVGGGSSLDAGKAIALLARQGGTPSDYALNRRPYGPPAPVCAVPTTAGTGSEVTRSAVITERGTHRKLTLKHEYLRPPLAVCDPTLTASLPPDVTAHTGVDALVHAIEGSTCKGAHPIARAYAREALGLIYRALPKAIRAGDPASRHDMLLGSLLAGLAFGSTDVASVHCLAEALGSLYETPHGLANAVMLLPTLRYNLPCAVEPYAWIARAMGLAREEDGAERAAEALLAGLRTWLESLDIPKLRDLPGVRPSDFDRLAELAYENTSTPSNPRPMAVSDYRAVLEMAYAD

SEQ ID NO: 1199 - protein, 383 aa, Artificial
  Substituion in SEQ ID NO 1191
MFSYSIQTHIEFGDGAVEHLPEHLVARGFGRRLLIVTDPGLVRAGVADRIAGLLSRAGFVPRVFAEVRPNPDETVCLAGRGAFFEHRADGVVAVGGGSSLDAGKAIALLARQGGTPSDYALNRRPYGPPAPVCAVPTTAGTGSEVTRSAVITERGTHRKLTLKHEYLRPPLAVCDPTLTASLPPDVTAHTGVDALVHAIEGSTCKGAHPIARAYAREALGLIYRALPKAIKAGDPASRHDMLLGSLLAGLAFGSTDVASVHCLAEALGSLYETPHGLANAVMLLPTLRYNLPCAVEPYAWIARAMGLAREEDGAERAAEALLAGLRTWLESLDIPKLRELPGVRPSDFDRLAELAYENTSTPSNPRPMAVSDYRAVLEMAYAD

SEQ ID NO: 1200 - protein, 383 aa, Artificial
  Substituion in SEQ ID NO 1191
MFSYSIQTHIEFGDGAVEHLPEHLVARGFGRRLLIVTDPGLVRAGVADRIAGLLSRAGFVPRVFAEVRPNPDETVCLAGRGAFFEHRADGVVAVGGGSSLDAGKAIALLARQGGTPSDYALNRRPYGPPAPVCAVPTTAGTGSEVTRSAVITERGTHRKLTLKHEYLRPPLAVCDPTLTASLPPDVTAHTGVDALVHAIEGSTCKGAHPIARAYAREALGLIYRALPKAIKAGDPASRHDMLLGSLLAGLAFGSTDVASVHCLAEALGSLYETPHGLANAVMLLPTLRYNLPCAVEPYAWIARAMGLAREEDGAERAAEAILAGLRTWLESLDIPKLRDLPGVRPSDFDRLAELAYENTSTPSNPRPMAVSDYRAVLEMAYAD

SEQ ID NO: 1201 - protein, 383 aa, Artificial
  Substituion in SEQ ID NO 1191
MFSYSIQTHIEFGDGAVEHLPEHLVARGFGRRLLIVTDPGLVRAGVADRIAGLLSKAGFVPRVFAEVRPNPDETVCLAGRGAFFEHRADGVVAVGGGSSLDAGKAIALLARQGGTPSDYALNRRPYGPPAPVCAVPTTAGTGSEVTRSAVITERGTHRKLTLKHEYLRPPLAVCDPTLTASLPPDVTAHTGVDALVHAIEGSTCKGAHPIARAYAREALGLIYRALPKAIKAGDPASRHDMLLGSLLAGLAFGSTDVASVHCLAEALGSLYETPHGLANAVMLLPTLRYNLPCAVEPYAWIARAMGLAREEDGAERAAEALLAGLRTWLESLDIPKLRDLPGVRPSDFDRLAELAYENTSTPSNPRPMAVSDYRAVLEMAYAD

SEQ ID NO: 1202 - protein, 383 aa, Artificial
  Substituion in SEQ ID NO 1191
MFSYSIQTHIEFGDGAVEHLPEHLVARGFGRRLLIVTDPGLVRAGVADRIAGLLSRAGFVPRVFAEVRPNPDETVCLAGRGAFFEHRADGVVAVGGGSSLDAGKAIALLARQGGTPSDYALNRRPYGPPAPVCAVPTTAGTGSEVTRSAVITERGTHRKLTLKHEYLRPPLAVCDPTLTASLPPDVTAHTGVDALVHAIEGSTCKGAHPIARAYAREALGLIYRALPKAIKAGDPASRHDMLLGSLLAGLAFGSTDVASVHCLAEALGSLYETPHGLANAVMLLPTLRYNLPCAVEPYAWIARAMGLAREEDGAERAAEALLAGLRTWLESLDIPKLRDIPGVRPSDFDRLAELAYENTSTPSNPRPMAVSDYRAVLEMAYAD

SEQ ID NO: 1203 - DNA, 1152 bp, Artificial
  Substituion in SEQ ID NO 1192
atgttctcctactccattcagacgcacatcgaatttggcgacggtgccgtcgaacaccttcccgagcacctcgtggcgcgagggtttgggcggcggctgctcatcgtgacggatccggggctggtgcgggccggtgtggcggatcgcatcgcgggccttctctctcgcgcgggctttgtgccccgggtgttcgccgaggttcgacccaatccggacgaaaccgtctgcctcgcaggtcgaggcgccttcttcgagcaccgcgcagacggcgtcgtggccgtgggcggcggcagcagcctggacgcgggcaaggccatcgcgctcctcgcgcgccagggcggcacgccgagcgactacgcgctcaacagacggccatacggtccgcctgcgcccgtctgcgccgtgcccaccaccgctgggacgggatcggaggtgacgagatcggccgtcatcacggaacgcgggacacaccgaaagctcaccctgaagcacgagtacctgcgcccacccctcgctgtgtgcgatccgaccctgaccgcaagcctcccgcccgacgtgacggctcacaccggcgtcgacgcgctcgtgcacgccattgaagggtcgacgtgcaagggagcgcaccccatcgcgcgggcctacgcgcgggaggcgctcggcctcatctaccgcgccctcccgaaggccatccgtgcaggcgatccggcctcgcggcacgacatgctgctcggcagcctgctcgcgggtctcgcgttcggatcgacggatgtggcctccgtgcactgcttggccgaggccctgggcagtctgtacgaaacgccgcacgggttggcgaacgcggtgatgcttttgccgacgcttcgttacaacctcccctgcgcggtggagccgtacgcctggatcgcgcgggccatggggctggcgcgcgaggaagatggcgccgagcgcgcggcggaagcgctccttgcggggcttcggacttggctcgagagcctcgacatcccgaaactgcgggatctgccgggcgtgaggccgtcggacttcgaccggttggcggagctcgcgtacgagaacacctcgacgccgagcaatccgcgcccgatggcggtgagcgactaccgcgcggtgctcgagatggcctatgcagactga

SEQ ID NO: 1204 - DNA, 1152 bp, Artificial
  Substituion in SEQ ID NO 1192
atgttctcctactccattcagacgcacatcgaatttggcgacggtgccgtcgaacaccttcccgagcacctcgtggcgcgagggtttgggcggcggctgctcatcgtgacggatccggggctggtgcgggccggtgtggcggatcgcatcgcgggccttctctctcgcgcgggctttgtgccccgggtgttcgccgaggttcgacccaatccggacgaaaccgtctgcctcgcaggtcgaggcgccttcttcgagcaccgcgcagacggcgtcgtggccgtgggcggcggcagcagcctggacgcgggcaaggccatcgcgctcctcgcgcgccagggcggcacgccgagcgactacgcgctcaacagacggccatacggtccgcctgcgcccgtctgcgccgtgcccaccaccgctgggacgggatcggaggtgacgagatcggccgtcatcacggaacgcgggacacaccgaaagctcaccctgaagcacgagtacctgcgcccacccctcgctgtgtgcgatccgaccctgaccgcaagcctcccgcccgacgtgacggctcacaccggcgtcgacgcgctcgtgcacgccattgaagggtcgacgtgcaagggagcgcaccccatcgcgcgggcctacgcgcgggaggcgctcggcctcatctaccgcgccctcccgaaggccatcaaggcaggcgatccggcctcgcggcacgacatgctgctcggcagcctgctcgcgggtctcgcgttcggatcgacggatgtggcctccgtgcactgcttggccgaggccctgggcagtctgtacgaaacgccgcacgggttggcgaacgcggtgatgcttttgccgacgcttcgttacaacctcccctgcgcggtggagccgtacgcctggatcgcgcgggccatggggctggcgcgcgaggaagatggcgccgagcgcgcggcggaagcgctccttgcggggcttcggacttggctcgagagcctcgacatcccgaaactgcgggaactgccgggcgtgaggccgtcggacttcgaccggttggcggagctcgcgtacgagaacacctcgacgccgagcaatccgcgcccgatggcggtgagcgactaccgcgcggtgctcgagatggcctatgcagactga

SEQ ID NO: 1205 - DNA, 1152 bp, Artificial
  Substituion in SEQ ID NO 1192
atgttctcctactccattcagacgcacatcgaatttggcgacggtgccgtcgaacaccttcccgagcacctcgtggcgcgagggtttgggcggcggctgctcatcgtgacggatccggggctggtgcgggccggtgtggcggatcgcatcgcgggccttctctctcgcgcgggctttgtgccccgggtgttcgccgaggttcgacccaatccggacgaaaccgtctgcctcgcaggtcgaggcgccttcttcgagcaccgcgcagacggcgtcgtggccgtgggcggcggcagcagcctggacgcgggcaaggccatcgcgctcctcgcgcgccagggcggcacgccgagcgactacgcgctcaacagacggccatacggtccgcctgcgcccgtctgcgccgtgcccaccaccgctgggacgggatcggaggtgacgagatcggccgtcatcacggaacgcgggacacaccgaaagctcaccctgaagcacgagtacctgcgcccacccctcgctgtgtgcgatccgaccctgaccgcaagcctcccgcccgacgtgacggctcacaccggcgtcgacgcgctcgtgcacgccattgaagggtcgacgtgcaagggagcgcaccccatcgcgcgggcctacgcgcgggaggcgctcggcctcatctaccgcgccctcccgaaggccatcaaggcaggcgatccggcctcgcggcacgacatgctgctcggcagcctgctcgcgggtctcgcgttcggatcgacggatgtggcctccgtgcactgcttggccgaggccctgggcagtctgtacgaaacgccgcacgggttggcgaacgcggtgatgcttttgccgacgcttcgttacaacctcccctgcgcggtggagccgtacgcctggatcgcgcgggccatggggctggcgcgcgaggaagatggcgccgagcgcgcggcggaagcgattcttgcggggcttcggacttggctcgagagcctcgacatcccgaaactgcgggatctgccgggcgtgaggccgtcggacttcgaccggttggcggagctcgcgtacgagaacacctcgacgccgagcaatccgcgcccgatggcggtgagcgactaccgcgcggtgctcgagatggcctatgcagactga

SEQ ID NO: 1206 - DNA, 1152 bp, Artificial
  Substituion in SEQ ID NO 1192
atgttctcctactccattcagacgcacatcgaatttggcgacggtgccgtcgaacaccttcccgagcacctcgtggcgcgagggtttgggcggcggctgctcatcgtgacggatccggggctggtgcgggccggtgtggcggatcgcatcgcgggccttctctctaaagcgggctttgtgccccgggtgttcgccgaggttcgacccaatccggacgaaaccgtctgcctcgcaggtcgaggcgccttcttcgagcaccgcgcagacggcgtcgtggccgtgggcggcggcagcagcctggacgcgggcaaggccatcgcgctcctcgcgcgccagggcggcacgccgagcgactacgcgctcaacagacggccatacggtccgcctgcgcccgtctgcgccgtgcccaccaccgctgggacgggatcggaggtgacgagatcggccgtcatcacggaacgcgggacacaccgaaagctcaccctgaagcacgagtacctgcgcccacccctcgctgtgtgcgatccgaccctgaccgcaagcctcccgcccgacgtgacggctcacaccggcgtcgacgcgctcgtgcacgccattgaagggtcgacgtgcaagggagcgcaccccatcgcgcgggcctacgcgcgggaggcgctcggcctcatctaccgcgccctcccgaaggccatcaaggcaggcgatccggcctcgcggcacgacatgctgctcggcagcctgctcgcgggtctcgcgttcggatcgacggatgtggcctccgtgcactgcttggccgaggccctgggcagtctgtacgaaacgccgcacgggttggcgaacgcggtgatgcttttgccgacgcttcgttacaacctcccctgcgcggtggagccgtacgcctggatcgcgcgggccatggggctggcgcgcgaggaagatggcgccgagcgcgcggcggaagcgctccttgcggggcttcggacttggctcgagagcctcgacatcccgaaactgcgggatctgccgggcgtgaggccgtcggacttcgaccggttggcggagctcgcgtacgagaacacctcgacgccgagcaatccgcgcccgatggcggtgagcgactaccgcgcggtgctcgagatggcctatgcagactga

SEQ ID NO: 1207 - DNA, 1152 bp, Artificial
  Substituion in SEQ ID NO 1192
atgttctcctactccattcagacgcacatcgaatttggcgacggtgccgtcgaacaccttcccgagcacctcgtggcgcgagggtttgggcggcggctgctcatcgtgacggatccggggctggtgcgggccggtgtggcggatcgcatcgcgggccttctctctcgcgcgggctttgtgccccgggtgttcgccgaggttcgacccaatccggacgaaaccgtctgcctcgcaggtcgaggcgccttcttcgagcaccgcgcagacggcgtcgtggccgtgggcggcggcagcagcctggacgcgggcaaggccatcgcgctcctcgcgcgccagggcggcacgccgagcgactacgcgctcaacagacggccatacggtccgcctgcgcccgtctgcgccgtgcccaccaccgctgggacgggatcggaggtgacgagatcggccgtcatcacggaacgcgggacacaccgaaagctcaccctgaagcacgagtacctgcgcccacccctcgctgtgtgcgatccgaccctgaccgcaagcctcccgcccgacgtgacggctcacaccggcgtcgacgcgctcgtgcacgccattgaagggtcgacgtgcaagggagcgcaccccatcgcgcgggcctacgcgcgggaggcgctcggcctcatctaccgcgccctcccgaaggccatcaaggcaggcgatccggcctcgcggcacgacatgctgctcggcagcctgctcgcgggtctcgcgttcggatcgacggatgtggcctccgtgcactgcttggccgaggccctgggcagtctgtacgaaacgccgcacgggttggcgaacgcggtgatgcttttgccgacgcttcgttacaacctcccctgcgcggtggagccgtacgcctggatcgcgcgggccatggggctggcgcgcgaggaagatggcgccgagcgcgcggcggaagcgctccttgcggggcttcggacttggctcgagagcctcgacatcccgaaactgcgggatattccgggcgtgaggccgtcggacttcgaccggttggcggagctcgcgtacgagaacacctcgacgccgagcaatccgcgcccgatggcggtgagcgactaccgcgcggtgctcgagatggcctatgcagactga

SEQ ID NO: 1208 - protein, 444 aa, Alicyclobacillus acidocaldarius
MGRTRSTNTRSSSTYTRRSCTSSKTAIGIPLCCPTGPDAIDFCEVVRRMPYIRSGFQFMARTTITNGVGSRVFLPETVRGLGGKRAFVVTDPGIVRAGLLDKILELFDLVPTPVTIAGVFDRVEQDAKAHIINEAARAYRECAADSLIALGGGSVLDTVKGIKWMVSRGLTDIRPALIGNVLEMWPEAQPIFIPHVALPTTAGTGAEASPIAVVFHDDLGVKVNLINPFINADIAILDPELTVGLPPSITAFTGFDALTHAIEGFFSPQANPFTDAYAIQSARMIFENLPKAVANGQDLTARANMLMASTMAIISFSLALNAIPVHNMAHAFGAKFGIPHGLANAVLLPNVMAAMPAFYRARIREFMAAIGLDAPSDPDAALESFIQRIRDLRQQVGLPATFADYQLDKRQLGKMVDLVHADPSGVVYRLPDAIIQRVTREVAS

SEQ ID NO: 1209 - DNA, 1335 bp, Alicyclobacillus acidocaldarius
ttgggccgtacgcgctcgacgaatacacgcagctcaagcacgtacacgcgtcgttcgtgcacgagctcgaaaaccgccattggtattccattgtgttgcccgacagggcctgacgcgatcgacttctgcgaggtggtgaggcgcatgccgtacattcgatctggctttcaattcatggcgcgaacgaccatcacaaacggcgtcggatcgcgcgtgtttttgccggagaccgtgcgcgggctcggcggcaagcgggcttttgtggtgacggacccgggcattgtccgcgccggcctcttggacaagatcctggagttgttcgatctcgtgccgacgcccgtgaccattgcgggcgtgttcgatcgcgtcgagcaggacgcgaaggcacacatcatcaacgaagccgcgcgtgcctaccgcgagtgcgccgcggatagtctcatcgccctcggcggaggcagcgtgctcgacacggtcaaggggatcaagtggatggtgagccgtggcctcaccgacatccgcccggcgctcatcggcaacgtgctcgagatgtggcccgaggcgcagcccatcttcattccgcacgtggcgctgcccaccaccgccggaaccggggcggaggcctcgcccatcgcggtggtcttccacgacgatctcggcgtcaaggtgaacctcatcaacccgttcatcaacgccgacatcgccattctcgatccggaactcaccgtcggcttgccgcccagcatcaccgccttcaccggcttcgacgcgctgacgcacgccatcgagggcttcttctcgccgcaggccaacccgttcaccgacgcgtacgccatccaatccgcgcgcatgatcttcgaaaacctgccgaaggccgtggccaacgggcaggacctgaccgcccgcgccaacatgctgatggcgagcacgatggccatcatcagcttcagcctggccttaaacgcgattcccgtccacaacatggcgcacgcgttcggcgcgaagttcggcattccgcacggactcgcgaacgcggtgctcctgccgaacgtgatggccgcgatgcccgcgttctatcgcgcgcgcatccgcgagttcatggcggccatcggcttggacgcgccgtccgatcccgatgcggcgctcgaatcgttcattcaacgcattcgcgatcttcgtcaacaggtcggcctgcctgcgacgttcgccgactaccagctcgacaagcggcagctcggcaagatggtggatctggtgcacgccgatccgtccggcgtcgtctatcgcctgccggatgccatcatccagcgcgtcacgcgcgaggtggcgagctaa

SEQ ID NO: 1210 - protein, 389 aa, Geobacillus kaustophilus HTA426
FWLRTAIYTGSNTRALVPDLFRGLGAKRVLLLSDRGLEQAGVVEKVASLFDLTTHGVGPELVGIFLDIRQDAESECVNEAVRYARAVGADALLAVGGGSVLDTAKGVKYALFKGLRDIKEAIPGGLRYESFPQAQFMPIPHIAIPTTAGTGSEVSPIAVIYNEELRLKTNIINPFINADVAVLDPDLTVGLPPKVTAFTGMDALTHAIEALASPMATALTDACALQAIRLIRDYLPEAVRDGGDIRARLEMLHASLLGITAFSFALNAIPVHNFAHAYGAMFRIPHGLANAVFLPVVMEAIPELYLPKAKLLAQALGIYDHGQGNEALLVKSIERIRQLRDDIGLPADFADYPMTEEQFAATIPAVASDPAAISFPMPPELIRAIGERV

SEQ ID NO: 1211 - protein, 375 aa, Vibrio shilonii AK1
NNFTFNLRTVVHSGASSIEAIPTLFKAKGAQRVLLVSDKGLESLGFVERLASLFSTEEKVKLAGIYTDIEADASCLDINRALEFAKQVNADSILALGGGSVIDASKGIKYGLEHKLDDIRDAIQGGGRLEVGPDVKPFSIPHIGVPTTAGTGAEASPIAVFYNEREQVKASLVVSGLECDIAVLDPELTVSLPAALTVSTGMDALTHAIEALASPLSNTFTDAYATQACRLILNNLPQVLQSPQNVAARCELLQASTMAISAFYSSLGGIPIHNCAHAFGAVAHIPHGDANSVLLPVVIEALPEFYLPSINKLAAVFGISPSLTDAEKHQEVVHSLRAFQALVNATQSFAKWNLDDNKKAQIVSGIEKDISFQFY

SEQ ID NO: 1212 - protein, 393 aa, Vibrio splendidus 12B01
NNFNFQLKTIVHAQENGIENIPSLFGRLGAQRVVLFSDKGLESLGFVEQFSALFVNEKVNQPGYEQAVQLVGVYTDIAPDATCDNINAAIEFANSVNADAILSVGGGSVIDASKGVKYAFHKQIDDIRTVIAGGGHIDVWPNNEDIRVPHIAVPTTAGTGAEASPIAVFYNEHENIKASLVASGLEADIAILDPTVTTKLPAHLTRSTAMDALTHAVEAIVSPMSNAFTDAYGIQAAKLIIENLPLALKEPENLTARGNLLQASTMAISAFYSSLGGIPIHNCAHAFGAISHIPHGDANTVLVPVVIEALPEFYMPNAAKLAQAFSVDTTGTDEMVYQRVLDFLNNFQTSVGAMKRFSSWDFDAQEKSNIAEAIEKDICFQFYPISKQTIETI

SEQ ID NO: 1213 - protein, 381 aa, Roseiflexus sp. RS-1
FEYHMRTRLMYKIGLARDFANEVVQLGVQRALLVADPGVVQAGLLDRVREGLEGSITVAGAFTDVPPDSSVATVEQGAAVARDAGADVLIAVGGGSAIDTAKAMRILLTEGGTLYDYQGANLLTRPLFPMIAIPTTAGTGSEVTPVAVIRDEQAEQKLFFLSPYLGPELAILDPEMTRTLPPRLTAATGMDALSHAIETFVGVGANPITDSLAIQAIDMISNYLRAATHNGEDMEARGNMLIAAAIAGIAFSTTGIGVNTGIIHAASHTVGAAYHVHHGTANSILLPHGMRFNAPVVPNRMVRIARAMGVNAGGRSEEDVIADGIAAVAKLAADCGLPTRLRDVGVPEDALPALAEGTLMDGAIMSNPRPVEYEDALAILR

SEQ ID NO: 1214 - protein, 332 aa, Pelotomaculum thermopropionicum SI
FWTSGTIITGRGSLKRIADEAKGLGATRVLIVTDPVLLKTGLIERVKEALAPAGLETGIFSGVEPEPRLQIVTECLKAVKEGGYDLIVAVGGGSSMDVSKAASVLMTNPGTINDYLGVNLIPRPGIPVIAVPTTAGTGSEVTPIAILSDVEEQLKKGVVSPYLLPRVAIVDPELTVTMPPAITAATGMDALTHAVESYISVNATPITDILALEAIRLIALNLRTAVANGQDIEARSNMSMASLLAGIAFANAGVGAVHALAYPLGAQFHVPHGVANAVLLPYVMESNLLGALPRFKTMALAMGEKVEDLSDRLAADKFNEAIKLLAADIRIP

SEQ ID NO: 1215 - protein, 444 aa, Artificial
  Substituion in SEQ ID NO 1208
MGRTRSTNTRSSSTYTRRSCTSSKTAIGIPLCCPTGPDAIDFCEVVRRMPYIRSGFQFMARTTITNGVGSRVFLPETVRGLGGKRAFVVTDPGIVRAGLLDKILELFDLVPTPVTIAGVFDRVEQDAKAHIINEAARAYRECAADSLIALGGGSVLDTVKGIKWMVSRGLTDIRPALIGNVLEMWPEAQPIFIPHVALPTTAGTGAEASPIAVVFHDDLGVKVNLINPFINADIAILDPELTVGLPPSITAFTGFDALTHAIEGFFSPQANPFTDAYAIQSARMIFENLPKAVANGQDLTARANMLMASTMAIISFSLALNAIPVHNMAHAFGAKFGIPHGLANAVLLPNVMAAMPAFYRARIREFMAAIGLEAPSDPDAALESFIQRIRDLRQQVGLPATFADYQLDKRQLGKMVDLVHADPSGVVYRLPDAIIQRVTREVAS

SEQ ID NO: 1216 - protein, 444 aa, Artificial
  Substituion in SEQ ID NO 1208
MGRTRSTNTRSSSTYTRRSCTSSKTAIGIPLCCPTGPDAIDFCEVVRRMPYIRSGFQFMARTTITNGVGSRVFLPETVRGLGGKRAFVVTDPGIVRAGLLDKILELFDLVPTPVTIAGVFDRVEQDAKAHIINEAARAYRECAADSLIALGGGSVLDTVKGIKWMVSRGLTDIRPALIGNVLEMWPEAQPIFIPHVALPTTAGTGAEASPIAVVFHDDLGVKVNLINPFINADIAILDPELTVGLPPSITAFTGFDALTHAIEGFFSPQANPFTDAYAIQSARMIFENLPKAIANGQDLTARANMLMASTMAIISFSLALNAIPVHNMAHAFGAKFGIPHGLANAVLLPNVMAAMPAFYRARIREFMAAIGLDAPSDPDAALESFIQRIRDLRQQVGLPATFADYQLDKRQLGKMVDLVHADPSGVVYRLPDAIIQRVTREVAS

SEQ ID NO: 1217 - protein, 444 aa, Artificial
  Substituion in SEQ ID NO 1208
MGRTRSTNTRSSSTYTRRSCTSSKTAIGIPLCCPTGPDAIDFCEVVRRMPYIRSGFQFMARTTITNGVGSRVFLPETVRGLGGKRAFVVTDPGIVRAGLLDKILELFDLVPTPVTIAGVFDRVEQDAKAHIINEAARAYRECAADSLIALGGGSVLDTVKGIKWMVSRGLTDIRPALIGNVLEMWPEAQPIFIPHVALPTTAGTGAEASPIAVVFHDDLGVKVNLINPFINADIAILDPELTVGLPPSITAFTGFDALTHAIEGFFSPQANPFTDAYAIQSARMIFEQLPKAVANGQDLTARANMLMASTMAIISFSLALNAIPVHNMAHAFGAKFGIPHGLANAVLLPNVMAAMPAFYRARIREFMAAIGLDAPSDPDAALESFIQRIRDLRQQVGLPATFADYQLDKRQLGKMVDLVHADPSGVVYRLPDAIIQRVTREVAS

SEQ ID NO: 1218 - protein, 444 aa, Artificial
  Substituion in SEQ ID NO 1208
MGRTRSTNTRSSSTYTRRSCTSSKTAIGIPLCCPTGPDAIDFCEVVRRMPYIRSGFQFMARTTITNGVGSRVFLPETVRGLGGKRAFVVTDPGIVRAGLLDKILELFDLVPTPVTIAGVFDRVEQDAKAHIINEAARAYRECAADSLIALGGGSVLDTVKGIKWMVSRGLTDIRPALIGNVLEMWPEAQPIFIPHVALPTTAGTGAEASPIAVVFHDDLGVKVNLINPFINADIAILDPELTVGLPPSITAFTGFDALTHAIEGFFSPQANPFTDAYAIQSARMIFENLPKAVANGQDLTARANMLMASTMAIISFSIALNAIPVHNMAHAFGAKFGIPHGLANAVLLPNVMAAMPAFYRARIREFMAAIGLDAPSDPDAALESFIQRIRDLRQQVGLPATFADYQLDKRQLGKMVDLVHADPSGVVYRLPDAIIQRVTREVAS

SEQ ID NO: 1219 - protein, 444 aa, Artificial
  Substituion in SEQ ID NO 1208
MGRTRSTNTRSSSTYTRRSCTSSKTAIGIPLCCPTGPDAIDFCEVVRRMPYIRSGFQFMARTTITNGVGSRVFLPETVRGLGGKRAFVVTDPGIVRAGLLDKILELFDLVPTPVTIAGVFDRVEQDAKAHIINEAARAYRECAADSLIALGGGSVLDTVKGIRWMVSRGLTDIRPALIGNVLEMWPEAQPIFIPHVALPTTAGTGAEASPIAVVFHDDLGVKVNLINPFINADIAILDPELTVGLPPSITAFTGFDALTHAIEGFFSPQANPFTDAYAIQSARMIFENLPKAVANGQDLTARANMLMASTMAIISFSLALNAIPVHNMAHAFGAKFGIPHGLANAVLLPNVMAAMPAFYRARIREFMAAIGLDAPSDPDAALESFIQRIRDLRQQVGLPATFADYQLDKRQLGKMVDLVHADPSGVVYRLPDAIIQRVTREVAS

SEQ ID NO: 1220 - DNA, 1335 bp, Artificial
  Substituion in SEQ ID NO 1209
ttgggccgtacgcgctcgacgaatacacgcagctcaagcacgtacacgcgtcgttcgtgcacgagctcgaaaaccgccattggtattccattgtgttgcccgacagggcctgacgcgatcgacttctgcgaggtggtgaggcgcatgccgtacattcgatctggctttcaattcatggcgcgaacgaccatcacaaacggcgtcggatcgcgcgtgtttttgccggagaccgtgcgcgggctcggcggcaagcgggcttttgtggtgacggacccgggcattgtccgcgccggcctcttggacaagatcctggagttgttcgatctcgtgccgacgcccgtgaccattgcgggcgtgttcgatcgcgtcgagcaggacgcgaaggcacacatcatcaacgaagccgcgcgtgcctaccgcgagtgcgccgcggatagtctcatcgccctcggcggaggcagcgtgctcgacacggtcaaggggatcaagtggatggtgagccgtggcctcaccgacatccgcccggcgctcatcggcaacgtgctcgagatgtggcccgaggcgcagcccatcttcattccgcacgtggcgctgcccaccaccgccggaaccggggcggaggcctcgcccatcgcggtggtcttccacgacgatctcggcgtcaaggtgaacctcatcaacccgttcatcaacgccgacatcgccattctcgatccggaactcaccgtcggcttgccgcccagcatcaccgccttcaccggcttcgacgcgctgacgcacgccatcgagggcttcttctcgccgcaggccaacccgttcaccgacgcgtacgccatccaatccgcgcgcatgatcttcgaaaacctgccgaaggccgtggccaacgggcaggacctgaccgcccgcgccaacatgctgatggcgagcacgatggccatcatcagcttcagcctggccttaaacgcgattcccgtccacaacatggcgcacgcgttcggcgcgaagttcggcattccgcacggactcgcgaacgcggtgctcctgccgaacgtgatggccgcgatgcccgcgttctatcgcgcgcgcatccgcgagttcatggcggccatcggcttggaagcgccgtccgatcccgatgcggcgctcgaatcgttcattcaacgcattcgcgatcttcgtcaacaggtcggcctgcctgcgacgttcgccgactaccagctcgacaagcggcagctcggcaagatggtggatctggtgcacgccgatccgtccggcgtcgtctatcgcctgccggatgccatcatccagcgcgtcacgcgcgaggtggcgagctaa

SEQ ID NO: 1221 - DNA, 1335 bp, Artificial
  Substituion in SEQ ID NO 1209
ttgggccgtacgcgctcgacgaatacacgcagctcaagcacgtacacgcgtcgttcgtgcacgagctcgaaaaccgccattggtattccattgtgttgcccgacagggcctgacgcgatcgacttctgcgaggtggtgaggcgcatgccgtacattcgatctggctttcaattcatggcgcgaacgaccatcacaaacggcgtcggatcgcgcgtgtttttgccggagaccgtgcgcgggctcggcggcaagcgggcttttgtggtgacggacccgggcattgtccgcgccggcctcttggacaagatcctggagttgttcgatctcgtgccgacgcccgtgaccattgcgggcgtgttcgatcgcgtcgagcaggacgcgaaggcacacatcatcaacgaagccgcgcgtgcctaccgcgagtgcgccgcggatagtctcatcgccctcggcggaggcagcgtgctcgacacggtcaaggggatcaagtggatggtgagccgtggcctcaccgacatccgcccggcgctcatcggcaacgtgctcgagatgtggcccgaggcgcagcccatcttcattccgcacgtggcgctgcccaccaccgccggaaccggggcggaggcctcgcccatcgcggtggtcttccacgacgatctcggcgtcaaggtgaacctcatcaacccgttcatcaacgccgacatcgccattctcgatccggaactcaccgtcggcttgccgcccagcatcaccgccttcaccggcttcgacgcgctgacgcacgccatcgagggcttcttctcgccgcaggccaacccgttcaccgacgcgtacgccatccaatccgcgcgcatgatcttcgaaaacctgccgaaggccattgccaacgggcaggacctgaccgcccgcgccaacatgctgatggcgagcacgatggccatcatcagcttcagcctggccttaaacgcgattcccgtccacaacatggcgcacgcgttcggcgcgaagttcggcattccgcacggactcgcgaacgcggtgctcctgccgaacgtgatggccgcgatgcccgcgttctatcgcgcgcgcatccgcgagttcatggcggccatcggcttggacgcgccgtccgatcccgatgcggcgctcgaatcgttcattcaacgcattcgcgatcttcgtcaacaggtcggcctgcctgcgacgttcgccgactaccagctcgacaagcggcagctcggcaagatggtggatctggtgcacgccgatccgtccggcgtcgtctatcgcctgccggatgccatcatccagcgcgtcacgcgcgaggtggcgagctaa

SEQ ID NO: 1222 - DNA, 1335 bp, Artificial
  Substituion in SEQ ID NO 1209
ttgggccgtacgcgctcgacgaatacacgcagctcaagcacgtacacgcgtcgttcgtgcacgagctcgaaaaccgccattggtattccattgtgttgcccgacagggcctgacgcgatcgacttctgcgaggtggtgaggcgcatgccgtacattcgatctggctttcaattcatggcgcgaacgaccatcacaaacggcgtcggatcgcgcgtgtttttgccggagaccgtgcgcgggctcggcggcaagcgggcttttgtggtgacggacccgggcattgtccgcgccggcctcttggacaagatcctggagttgttcgatctcgtgccgacgcccgtgaccattgcgggcgtgttcgatcgcgtcgagcaggacgcgaaggcacacatcatcaacgaagccgcgcgtgcctaccgcgagtgcgccgcggatagtctcatcgccctcggcggaggcagcgtgctcgacacggtcaaggggatcaagtggatggtgagccgtggcctcaccgacatccgcccggcgctcatcggcaacgtgctcgagatgtggcccgaggcgcagcccatcttcattccgcacgtggcgctgcccaccaccgccggaaccggggcggaggcctcgcccatcgcggtggtcttccacgacgatctcggcgtcaaggtgaacctcatcaacccgttcatcaacgccgacatcgccattctcgatccggaactcaccgtcggcttgccgcccagcatcaccgccttcaccggcttcgacgcgctgacgcacgccatcgagggcttcttctcgccgcaggccaacccgttcaccgacgcgtacgccatccaatccgcgcgcatgatcttcgaacaactgccgaaggccgtggccaacgggcaggacctgaccgcccgcgccaacatgctgatggcgagcacgatggccatcatcagcttcagcctggccttaaacgcgattcccgtccacaacatggcgcacgcgttcggcgcgaagttcggcattccgcacggactcgcgaacgcggtgctcctgccgaacgtgatggccgcgatgcccgcgttctatcgcgcgcgcatccgcgagttcatggcggccatcggcttggacgcgccgtccgatcccgatgcggcgctcgaatcgttcattcaacgcattcgcgatcttcgtcaacaggtcggcctgcctgcgacgttcgccgactaccagctcgacaagcggcagctcggcaagatggtggatctggtgcacgccgatccgtccggcgtcgtctatcgcctgccggatgccatcatccagcgcgtcacgcgcgaggtggcgagctaa

SEQ ID NO: 1223 - DNA, 1335 bp, Artificial
  Substituion in SEQ ID NO 1209
ttgggccgtacgcgctcgacgaatacacgcagctcaagcacgtacacgcgtcgttcgtgcacgagctcgaaaaccgccattggtattccattgtgttgcccgacagggcctgacgcgatcgacttctgcgaggtggtgaggcgcatgccgtacattcgatctggctttcaattcatggcgcgaacgaccatcacaaacggcgtcggatcgcgcgtgtttttgccggagaccgtgcgcgggctcggcggcaagcgggcttttgtggtgacggacccgggcattgtccgcgccggcctcttggacaagatcctggagttgttcgatctcgtgccgacgcccgtgaccattgcgggcgtgttcgatcgcgtcgagcaggacgcgaaggcacacatcatcaacgaagccgcgcgtgcctaccgcgagtgcgccgcggatagtctcatcgccctcggcggaggcagcgtgctcgacacggtcaaggggatcaagtggatggtgagccgtggcctcaccgacatccgcccggcgctcatcggcaacgtgctcgagatgtggcccgaggcgcagcccatcttcattccgcacgtggcgctgcccaccaccgccggaaccggggcggaggcctcgcccatcgcggtggtcttccacgacgatctcggcgtcaaggtgaacctcatcaacccgttcatcaacgccgacatcgccattctcgatccggaactcaccgtcggcttgccgcccagcatcaccgccttcaccggcttcgacgcgctgacgcacgccatcgagggcttcttctcgccgcaggccaacccgttcaccgacgcgtacgccatccaatccgcgcgcatgatcttcgaaaacctgccgaaggccgtggccaacgggcaggacctgaccgcccgcgccaacatgctgatggcgagcacgatggccatcatcagcttcagcattgccttaaacgcgattcccgtccacaacatggcgcacgcgttcggcgcgaagttcggcattccgcacggactcgcgaacgcggtgctcctgccgaacgtgatggccgcgatgcccgcgttctatcgcgcgcgcatccgcgagttcatggcggccatcggcttggacgcgccgtccgatcccgatgcggcgctcgaatcgttcattcaacgcattcgcgatcttcgtcaacaggtcggcctgcctgcgacgttcgccgactaccagctcgacaagcggcagctcggcaagatggtggatctggtgcacgccgatccgtccggcgtcgtctatcgcctgccggatgccatcatccagcgcgtcacgcgcgaggtggcgagctaa

SEQ ID NO: 1224 - DNA, 1335 bp, Artificial
  Substituion in SEQ ID NO 1209
ttgggccgtacgcgctcgacgaatacacgcagctcaagcacgtacacgcgtcgttcgtgcacgagctcgaaaaccgccattggtattccattgtgttgcccgacagggcctgacgcgatcgacttctgcgaggtggtgaggcgcatgccgtacattcgatctggctttcaattcatggcgcgaacgaccatcacaaacggcgtcggatcgcgcgtgtttttgccggagaccgtgcgcgggctcggcggcaagcgggcttttgtggtgacggacccgggcattgtccgcgccggcctcttggacaagatcctggagttgttcgatctcgtgccgacgcccgtgaccattgcgggcgtgttcgatcgcgtcgagcaggacgcgaaggcacacatcatcaacgaagccgcgcgtgcctaccgcgagtgcgccgcggatagtctcatcgccctcggcggaggcagcgtgctcgacacggtcaaggggatccgttggatggtgagccgtggcctcaccgacatccgcccggcgctcatcggcaacgtgctcgagatgtggcccgaggcgcagcccatcttcattccgcacgtggcgctgcccaccaccgccggaaccggggcggaggcctcgcccatcgcggtggtcttccacgacgatctcggcgtcaaggtgaacctcatcaacccgttcatcaacgccgacatcgccattctcgatccggaactcaccgtcggcttgccgcccagcatcaccgccttcaccggcttcgacgcgctgacgcacgccatcgagggcttcttctcgccgcaggccaacccgttcaccgacgcgtacgccatccaatccgcgcgcatgatcttcgaaaacctgccgaaggccgtggccaacgggcaggacctgaccgcccgcgccaacatgctgatggcgagcacgatggccatcatcagcttcagcctggccttaaacgcgattcccgtccacaacatggcgcacgcgttcggcgcgaagttcggcattccgcacggactcgcgaacgcggtgctcctgccgaacgtgatggccgcgatgcccgcgttctatcgcgcgcgcatccgcgagttcatggcggccatcggcttggacgcgccgtccgatcccgatgcggcgctcgaatcgttcattcaacgcattcgcgatcttcgtcaacaggtcggcctgcctgcgacgttcgccgactaccagctcgacaagcggcagctcggcaagatggtggatctggtgcacgccgatccgtccggcgtcgtctatcgcctgccggatgccatcatccagcgcgtcacgcgcgaggtggcgagctaa

SEQ ID NO: 1225 - protein, 510 aa, Alicyclobacillus acidocaldarius
MVMTSVRLPEYGMFIDGEYTPAESGEMFEVVNPATGQPCARVAKSDARDVDRAVRSARRAFESGEWSRAKPHERAQVLLRFADEIVAHAQEIAFLEILTSGATVRRVSNADLLLIVDLLQQTARFAQAYEYAKTLPLRPFPQPSHNQVWREPVGVCAGITAWNYPLILAMWKLAPALAMGNSIVLKPASNTPLSTLKLAELAAKAGLPKGVFNVVTGPGSSVGEALVTHPEVDKIAFTGSTEVGKRIMQLAAQGVKRVTLELGGKSPAIVLPDADLDLAIPGILFGVFLHAGQVCECGTRVIVHEDIYEEVVNRLAEMASQIKLGNPLDDKVGMGPIISESQMNTILSYIESGKAEGARLVCGGQRATGGGLDAGYFVQPTIFADVDNRMKIAQEEIFGPVLAVMKARDVDEAVRLANDTVYGLAGGVWTRDLNQAYRIAREIRAGTIWVNDWHMFRSDAPFGGYKMSGFGREIGPYALDEYTQLKHVHASFVHELENRHWYSIVLPDRA

SEQ ID NO: 1226 - DNA, 1533 bp, Alicyclobacillus acidocaldarius
atggtcatgacgagtgtgagactccccgagtacggcatgttcatcgacggcgagtacacgcctgcggaaagcggggagatgttcgaggtggtgaatcccgccacggggcagccctgcgcgcgcgtggcgaagtcggacgcgcgagacgtggatcgcgccgtgcgaagcgctcgccgcgcgttcgagtcgggcgagtggtcccgcgccaagccccacgagcgggcccaggtgttgcttcggtttgcggacgagatcgtcgcgcacgcgcaggagattgcgtttctggagatcttgacctccggcgcgacggtgcggcgcgtgtcgaacgccgacttgcttctcattgtcgatttgctccagcagaccgcgcggttcgcgcaggcgtacgaatacgcgaagacgcttccgctccggccgtttccgcagccgagccacaaccaggtatggagggagcccgtgggcgtgtgcgccgggatcacggcgtggaactatccactcatcctcgcgatgtggaagctcgcgcccgcgctcgccatggggaactccatcgtgttgaaaccggcgtccaacacgccgctttccacgctcaagcttgccgagctcgcggcgaaggccgggctgccgaagggcgtgttcaacgtcgtcacggggccaggatcgtcggtgggcgaggcgctcgtcacgcacccggaggtcgacaaaatcgccttcaccggatccaccgaggtgggcaagcggatcatgcagctcgcggcgcagggcgtcaagcgcgtgaccctggagttgggcggcaagtcgccggccatcgtgctgccggacgcggacctggatctggcgatacccggcatcctgtttggcgtcttcctgcacgccgggcaggtgtgcgagtgcgggacgcgcgtgattgtccacgaggacatctacgaggaagtcgtgaatcgcctggccgagatggcctcgcagatcaagctcggcaatccgctcgatgacaaggtgggcatggggcccatcatctccgagtcgcagatgaacaccattctgagctacatcgagtcgggcaaggcggaaggcgcgcgcctcgtgtgcggcggccagcgcgccacgggaggcggcctggacgcaggttactttgtgcagccgaccatcttcgccgacgtcgacaaccgcatgaaaattgcgcaggaggagatcttcggccccgtgctcgcggtcatgaaggcgcgggacgtggacgaggcggttcggctggccaacgataccgtctatgggctggcgggcggcgtctggacgcgcgatctcaaccaggcctatcgcatcgcgcgcgagatccgggcggggaccatctgggtgaacgactggcacatgttccgcagcgacgcgccgttcggcggctacaagatgagcgggttcggccgcgagattgggccgtacgcgctcgacgaatacacgcagctcaagcacgtacacgcgtcgttcgtgcacgagctcgaaaaccgccattggtattccattgtgttgcccgacagggcctga

SEQ ID NO: 1227 - protein, 501 aa, Geobacillus kaustophilus HTA426
THVQVHHFPLFIDGQWQPATSGETFHVYNPATGEVVATVAKATADDVDRAVKAARKAFDETDWKAMKPKERARVLNAIAQAIAANAQELAYLEAISSGGTIRRISSIDILQTVDLFQTMANIVQEYPFSETLPIPPFPGPAHNFVWREPIGVCAAITPWNLPLMIASWKIAPALAAGNTIVVKPASYTPLSTLKLAEIISSFVPPGVINVVAGPGADVGEALVRHPQVDKVAFTGSTEVGRRIMALAAETVKNVTLELGGKSPNILLEDADLDLAVPGSLFGVFLHSGQLCESGTRLFVPDRLHDEVVERLVALTKTLQIGHPLDPATDVGPVISKRQKETVLSYIEAGKQEGATIVCGGHEVEVPGCEGGHFVAPTIFSNVTNDMKIAQEEIFGPVLSIIRYHDVEEAVTMANDTIYGLAAGVWTRDVNKAYAIAGRLQAGVVWINDWHMLRNDAPFGGYKQSGIGREMGKYSLDAYTQLKHVHTSMVPELGKRKWYQVL

SEQ ID NO: 1228 - protein, 500 aa, Herpetosiphon aurantiacus ATCC 23779
LRSFGLYIDGAWVAASDAASETLYNPATGEPVAQVARATIHDIDRAVGAARKSFDIGSWAQMRPVDRAKTIEAIADLLEENTDELAELETLNGGATLRKSSWLDIPVGIEHLRYFADLARQHPMQTLPYIDFPSPSANAVWREPIGVCGQIIPWNYPFLMAIWKIGPALAAGNSLVLKPASLTPVTALRMAELIHEADLLPHGVFNVVTGPGGLVGERLTSHPAVDKIAFTGSTEVGRRIAEVAGRNLKRVTLELGGKSPVVVLPNADLDLAVDGAIWAAFMHSGQSCEAGTRLLLPDSLHDQFVERMVARVEQLVLGDPLDLTTDLGPLVSAAQKRAVEAYIELGIQEGATLRCGGVGIDDPNLANGHFVRPTIFTNVHNQMRIAQEEIFGPVLSVIRYHTVGEAITLANDTNYGLAASVWSRDLQDAQEVARAIRAGTVWINDHHLINAKAPFGGYKDSGIGRELGPNALDAYSEIKHIHTDLTQERTRRIWVDIVTP

SEQ ID NO: 1229 - protein, 501 aa, Chloroflexus aurantiacus J-10-fl
LPHYDLYIDGAWQPAENGQTFTVYDPATSQPIATCASATHSDVDRAVRAARAAFDHGPWPHTSPAQRAEILHAIADALEARNFELAEIESRDAGVPIRKTTYNDITLGLEILRGCAEMARKHPYEPLPWNDLPSVSWNFVWREPIGVCAQIIPWNYAFCMAAWKLGPALATGNTVVFKPSSLAPLSTLAIFQTIHDLNLLPKGVINLVLGPGGDVGEYLVTHPAVDKVAFTGSTEVGRKIMALAAPHIKRVTLELGGKNAMLILPDADLDLVVDGVLWGAFYHSGQLCEAGSRLLVPHALHDTLVERLVERVRGMRIGDPMDLETDIGPLISERQREKVEYYIAVGREEGATVVIGGGRPIGEAFANGHYVEPTIFTGVRPEMRIAREEIFGPVLSVIAYDEIGEAIRIANDSIYGLAASVWSRDLQHALSVVRRIRAGTVWINEHHVLNPRAPFGGYRQSGFGREMGRYGLDEYTEVKHIHVDLMQRRQGRLWWDTLLPE

SEQ ID NO: 1230 - protein, 501 aa, Chloroflexus aggregans DSM 9485
LPHYDLYINGAWQPASSKQTFTVFDPANGQPLATCASASPTDVDRAIAAARSAFDHGPWPHTSPARRAEILHALADALEARNFELAEIESRNAGVPLRKTTYNDITLGIEILRGCAEMARKHPYEPLPWNDLPSVSWNFVWREPIGVCAQIIPWNYAFCMAAWKLGPALATGNTVVFKPSSLAPLSTLAIIQAIHELNLLPKGVVNLVLGPGGEVGEYLVAHPDVDKVAFTGSTEVGRKIMALAAPHIKRVTLELGGKNAMIILPDADLDLVVDGVLWGAFYHSGQLCEAGSRLLVPHALHDTLVSRLVERVRTMRIGDPMDLETDIGPLISEQQRAKVERYIAIGREEGATVVIGGRRPPDEARAKGYYVEPTIFTGVRPEMRIAREEIFGPVLAVIAYEEVSEAIKIANDSIYGLAASVWSRDLQQALAVAKRIRAGTVWINEHHVLNPQAPFGGYRQSGFGREMGRYGLDEYTEVKHIHVDLMQRRQGRLWWDTLLPE

SEQ ID NO: 1231 - protein, 499 aa, Roseiflexus sp. RS-1
LPCYGLYIDGSWVDAEGGTMPVNEPALGRPMARVARGSAADVDRAVAAAREAFDRGPWPHTPGHERARVLNAIADLIEEHTAEFAELETRNLGAPLRKTTFVDIPWSVEHLRVFAELATIHPYEPLPWTDVPSVSWNFVWREPIGVCGQIVPWNYPLLMTIWKIAPALAAGNTIVLKPASYTPLTALRLTQLIHEAGLLPRGVLNVVTGPGAEVGDALARHPGVDKVSFTGSTETGRHIMRLASDTIKRLTLELGGKSPSLVMPDADLELATDGVLFGVFFNGGQSCEAGTRCLVPESLHDEFLERLVTRARSLRIGDPLDLETDLGPLVSEAQCRIVEEYIEVGKNEGARLVTGGRRVRVPGFERGPFVEPTIFTNVLNGTRLAQEEIFGPVLSVIPYRTVTEAIELANASRYGLGAAVWSRDLQGAIEVAKRIRTGTVWINDHHIILPRAPFGGYKQSGIGREHGIYGLMAYTELKHIHVDLMQKRTGRVWWDVLIP

SEQ ID NO: 1232 - protein, 510 aa, Artificial
  Substituion in SEQ ID NO 1225
MVMTSVRLPEYGMFIDGEYTPAESGEMFEVVNPATGQPCARVAKSDARDVDRAVRSARKAFESGEWSRAKPHERAQVLLRFADEIVAHAQEIAFLEILTSGATVRRVSNADLLLIVDLLQQTARFAQAYEYAKTLPLRPFPQPSHNQVWREPVGVCAGITAWNYPLILAMWKLAPALAMGNSIVLKPASNTPLSTLKLAELAAKAGLPKGVFNVVTGPGSSVGEALVTHPEVDKIAFTGSTEVGKRIMQLAAQGVKRVTLELGGKSPAIVLPDADLDLAIPGILFGVFLHAGQVCECGTRVIVHEDIYEEVVNRLAEMASQIKLGNPLDDKVGMGPIISESQMNTILSYIESGKAEGARLVCGGQRATGGGLDAGYFVQPTIFADVDNRMKIAQEEIFGPVLAVMKARDVDEAVRLANDTVYGLAGGVWTRDLNQAYRIAREIRAGTIWVNDWHMFRSDAPFGGYKMSGFGREIGPYALDEYTQLKHVHASFVHELENRHWYSIVLPDRA

SEQ ID NO: 1233 - protein, 510 aa, Artificial
  Substituion in SEQ ID NO 1225
MVMTSVRLPEYGMFIDGEYTPAESGEMFEVVNPATGQPCARVAKSDARDVDRAVRSARRAFESGEWSRAKPHERAQVLLRFADEIVAHAQEIAFLEILTSGATVRRVSNADLLLIVDLLQQTARFAQAYEYAKTLPLKPFPQPSHNQVWREPVGVCAGITAWNYPLILAMWKLAPALAMGNSIVLKPASNTPLSTLKLAELAAKAGLPKGVFNVVTGPGSSVGEALVTHPEVDKIAFTGSTEVGKRIMQLAAQGVKRVTLELGGKSPAIVLPDADLDLAIPGILFGVFLHAGQVCECGTRVIVHEDIYEEVVNRLAEMASQIKLGNPLDDKVGMGPIISESQMNTILSYIESGKAEGARLVCGGQRATGGGLDAGYFVQPTIFADVDNRMKIAQEEIFGPVLAVMKARDVDEAVRLANDTVYGLAGGVWTRDLNQAYRIAREIRAGTIWVNDWHMFRSDAPFGGYKMSGFGREIGPYALDEYTQLKHVHASFVHELENRHWYSIVLPDRA

SEQ ID NO: 1234 - protein, 510 aa, Artificial
  Substituion in SEQ ID NO 1225
MVMTSVRLPEYGMFIDGEYTPAESGEMFEVVNPATGQPCARVAKSDARDVDRAVRSARRAFESGEWSRAKPHERAQILLRFADEIVAHAQEIAFLEILTSGATVRRVSNADLLLIVDLLQQTARFAQAYEYAKTLPLRPFPQPSHNQVWREPVGVCAGITAWNYPLILAMWKLAPALAMGNSIVLKPASNTPLSTLKLAELAAKAGLPKGVFNVVTGPGSSVGEALVTHPEVDKIAFTGSTEVGKRIMQLAAQGVKRVTLELGGKSPAIVLPDADLDLAIPGILFGVFLHAGQVCECGTRVIVHEDIYEEVVNRLAEMASQIKLGNPLDDKVGMGPIISESQMNTILSYIESGKAEGARLVCGGQRATGGGLDAGYFVQPTIFADVDNRMKIAQEEIFGPVLAVMKARDVDEAVRLANDTVYGLAGGVWTRDLNQAYRIAREIRAGTIWVNDWHMFRSDAPFGGYKMSGFGREIGPYALDEYTQLKHVHASFVHELENRHWYSIVLPDRA

SEQ ID NO: 1235 - protein, 510 aa, Artificial
  Substituion in SEQ ID NO 1225
MVMTSVRLPEYGMFIDGEYTPAESGEMFEVVNPATGQPCARVAKSDARDVDRAVRSARRAFESGEWSRAKPHERAQVLLRFADEIVAHAQEIAFLEILTSGATVRRVSNADLLLIVDLLQQTARFAQAYEYAKTLPLRPFPQPSHNQVWREPVGVCAGITAWNYPLLLAMWKLAPALAMGNSIVLKPASNTPLSTLKLAELAAKAGLPKGVFNVVTGPGSSVGEALVTHPEVDKIAFTGSTEVGKRIMQLAAQGVKRVTLELGGKSPAIVLPDADLDLAIPGILFGVFLHAGQVCECGTRVIVHEDIYEEVVNRLAEMASQIKLGNPLDDKVGMGPIISESQMNTILSYIESGKAEGARLVCGGQRATGGGLDAGYFVQPTIFADVDNRMKIAQEEIFGPVLAVMKARDVDEAVRLANDTVYGLAGGVWTRDLNQAYRIAREIRAGTIWVNDWHMFRSDAPFGGYKMSGFGREIGPYALDEYTQLKHVHASFVHELENRHWYSIVLPDRA

SEQ ID NO: 1236 - protein, 510 aa, Artificial
  Substituion in SEQ ID NO 1225
MVMTSVRLPEYGMFIDGEYTPAESGEMFEVVNPATGQPCARVAKSDARDVDRAVRSARRAFESGEWSRAKPHERAQVLLRFADEIVAHAQEIAFLEILTSGATVRRVSNADLLLIVDLLQQTARFAQAYEYAKTLPLRPFPQPSHNQVWREPVGVCAGITAWNYPLILAMWKLAPALAMGNSIVLKPASNTPLSTLKLAELAAKAGLPKGVFNVVTGPGSSVGEALVTHPDVDKIAFTGSTEVGKRIMQLAAQGVKRVTLELGGKSPAIVLPDADLDLAIPGILFGVFLHAGQVCECGTRVIVHEDIYEEVVNRLAEMASQIKLGNPLDDKVGMGPIISESQMNTILSYIESGKAEGARLVCGGQRATGGGLDAGYFVQPTIFADVDNRMKIAQEEIFGPVLAVMKARDVDEAVRLANDTVYGLAGGVWTRDLNQAYRIAREIRAGTIWVNDWHMFRSDAPFGGYKMSGFGREIGPYALDEYTQLKHVHASFVHELENRHWYSIVLPDRA

SEQ ID NO: 1237 - DNA, 1533 bp, Artificial
  Substituion in SEQ ID NO 1226
atggtcatgacgagtgtgagactccccgagtacggcatgttcatcgacggcgagtacacgcctgcggaaagcggggagatgttcgaggtggtgaatcccgccacggggcagccctgcgcgcgcgtggcgaagtcggacgcgcgagacgtggatcgcgccgtgcgaagcgctcgcaaagcgttcgagtcgggcgagtggtcccgcgccaagccccacgagcgggcccaggtgttgcttcggtttgcggacgagatcgtcgcgcacgcgcaggagattgcgtttctggagatcttgacctccggcgcgacggtgcggcgcgtgtcgaacgccgacttgcttctcattgtcgatttgctccagcagaccgcgcggttcgcgcaggcgtacgaatacgcgaagacgcttccgctccggccgtttccgcagccgagccacaaccaggtatggagggagcccgtgggcgtgtgcgccgggatcacggcgtggaactatccactcatcctcgcgatgtggaagctcgcgcccgcgctcgccatggggaactccatcgtgttgaaaccggcgtccaacacgccgctttccacgctcaagcttgccgagctcgcggcgaaggccgggctgccgaagggcgtgttcaacgtcgtcacggggccaggatcgtcggtgggcgaggcgctcgtcacgcacccggaggtcgacaaaatcgccttcaccggatccaccgaggtgggcaagcggatcatgcagctcgcggcgcagggcgtcaagcgcgtgaccctggagttgggcggcaagtcgccggccatcgtgctgccggacgcggacctggatctggcgatacccggcatcctgtttggcgtcttcctgcacgccgggcaggtgtgcgagtgcgggacgcgcgtgattgtccacgaggacatctacgaggaagtcgtgaatcgcctggccgagatggcctcgcagatcaagctcggcaatccgctcgatgacaaggtgggcatggggcccatcatctccgagtcgcagatgaacaccattctgagctacatcgagtcgggcaaggcggaaggcgcgcgcctcgtgtgcggcggccagcgcgccacgggaggcggcctggacgcaggttactttgtgcagccgaccatcttcgccgacgtcgacaaccgcatgaaaattgcgcaggaggagatcttcggccccgtgctcgcggtcatgaaggcgcgggacgtggacgaggcggttcggctggccaacgataccgtctatgggctggcgggcggcgtctggacgcgcgatctcaaccaggcctatcgcatcgcgcgcgagatccgggcggggaccatctgggtgaacgactggcacatgttccgcagcgacgcgccgttcggcggctacaagatgagcgggttcggccgcgagattgggccgtacgcgctcgacgaatacacgcagctcaagcacgtacacgcgtcgttcgtgcacgagctcgaaaaccgccattggtattccattgtgttgcccgacagggcctga

SEQ ID NO: 1238 - DNA, 1533 bp, Artificial
  Substituion in SEQ ID NO 1226
atggtcatgacgagtgtgagactccccgagtacggcatgttcatcgacggcgagtacacgcctgcggaaagcggggagatgttcgaggtggtgaatcccgccacggggcagccctgcgcgcgcgtggcgaagtcggacgcgcgagacgtggatcgcgccgtgcgaagcgctcgccgcgcgttcgagtcgggcgagtggtcccgcgccaagccccacgagcgggcccaggtgttgcttcggtttgcggacgagatcgtcgcgcacgcgcaggagattgcgtttctggagatcttgacctccggcgcgacggtgcggcgcgtgtcgaacgccgacttgcttctcattgtcgatttgctccagcagaccgcgcggttcgcgcaggcgtacgaatacgcgaagacgcttccgctcaaaccgtttccgcagccgagccacaaccaggtatggagggagcccgtgggcgtgtgcgccgggatcacggcgtggaactatccactcatcctcgcgatgtggaagctcgcgcccgcgctcgccatggggaactccatcgtgttgaaaccggcgtccaacacgccgctttccacgctcaagcttgccgagctcgcggcgaaggccgggctgccgaagggcgtgttcaacgtcgtcacggggccaggatcgtcggtgggcgaggcgctcgtcacgcacccggaggtcgacaaaatcgccttcaccggatccaccgaggtgggcaagcggatcatgcagctcgcggcgcagggcgtcaagcgcgtgaccctggagttgggcggcaagtcgccggccatcgtgctgccggacgcggacctggatctggcgatacccggcatcctgtttggcgtcttcctgcacgccgggcaggtgtgcgagtgcgggacgcgcgtgattgtccacgaggacatctacgaggaagtcgtgaatcgcctggccgagatggcctcgcagatcaagctcggcaatccgctcgatgacaaggtgggcatggggcccatcatctccgagtcgcagatgaacaccattctgagctacatcgagtcgggcaaggcggaaggcgcgcgcctcgtgtgcggcggccagcgcgccacgggaggcggcctggacgcaggttactttgtgcagccgaccatcttcgccgacgtcgacaaccgcatgaaaattgcgcaggaggagatcttcggccccgtgctcgcggtcatgaaggcgcgggacgtggacgaggcggttcggctggccaacgataccgtctatgggctggcgggcggcgtctggacgcgcgatctcaaccaggcctatcgcatcgcgcgcgagatccgggcggggaccatctgggtgaacgactggcacatgttccgcagcgacgcgccgttcggcggctacaagatgagcgggttcggccgcgagattgggccgtacgcgctcgacgaatacacgcagctcaagcacgtacacgcgtcgttcgtgcacgagctcgaaaaccgccattggtattccattgtgttgcccgacagggcctga

SEQ ID NO: 1239 - DNA, 1533 bp, Artificial
  Substituion in SEQ ID NO 1226
atggtcatgacgagtgtgagactccccgagtacggcatgttcatcgacggcgagtacacgcctgcggaaagcggggagatgttcgaggtggtgaatcccgccacggggcagccctgcgcgcgcgtggcgaagtcggacgcgcgagacgtggatcgcgccgtgcgaagcgctcgccgcgcgttcgagtcgggcgagtggtcccgcgccaagccccacgagcgggcccagattttgcttcggtttgcggacgagatcgtcgcgcacgcgcaggagattgcgtttctggagatcttgacctccggcgcgacggtgcggcgcgtgtcgaacgccgacttgcttctcattgtcgatttgctccagcagaccgcgcggttcgcgcaggcgtacgaatacgcgaagacgcttccgctccggccgtttccgcagccgagccacaaccaggtatggagggagcccgtgggcgtgtgcgccgggatcacggcgtggaactatccactcatcctcgcgatgtggaagctcgcgcccgcgctcgccatggggaactccatcgtgttgaaaccggcgtccaacacgccgctttccacgctcaagcttgccgagctcgcggcgaaggccgggctgccgaagggcgtgttcaacgtcgtcacggggccaggatcgtcggtgggcgaggcgctcgtcacgcacccggaggtcgacaaaatcgccttcaccggatccaccgaggtgggcaagcggatcatgcagctcgcggcgcagggcgtcaagcgcgtgaccctggagttgggcggcaagtcgccggccatcgtgctgccggacgcggacctggatctggcgatacccggcatcctgtttggcgtcttcctgcacgccgggcaggtgtgcgagtgcgggacgcgcgtgattgtccacgaggacatctacgaggaagtcgtgaatcgcctggccgagatggcctcgcagatcaagctcggcaatccgctcgatgacaaggtgggcatggggcccatcatctccgagtcgcagatgaacaccattctgagctacatcgagtcgggcaaggcggaaggcgcgcgcctcgtgtgcggcggccagcgcgccacgggaggcggcctggacgcaggttactttgtgcagccgaccatcttcgccgacgtcgacaaccgcatgaaaattgcgcaggaggagatcttcggccccgtgctcgcggtcatgaaggcgcgggacgtggacgaggcggttcggctggccaacgataccgtctatgggctggcgggcggcgtctggacgcgcgatctcaaccaggcctatcgcatcgcgcgcgagatccgggcggggaccatctgggtgaacgactggcacatgttccgcagcgacgcgccgttcggcggctacaagatgagcgggttcggccgcgagattgggccgtacgcgctcgacgaatacacgcagctcaagcacgtacacgcgtcgttcgtgcacgagctcgaaaaccgccattggtattccattgtgttgcccgacagggcctga

SEQ ID NO: 1240 - DNA, 1533 bp, Artificial
  Substituion in SEQ ID NO 1226
atggtcatgacgagtgtgagactccccgagtacggcatgttcatcgacggcgagtacacgcctgcggaaagcggggagatgttcgaggtggtgaatcccgccacggggcagccctgcgcgcgcgtggcgaagtcggacgcgcgagacgtggatcgcgccgtgcgaagcgctcgccgcgcgttcgagtcgggcgagtggtcccgcgccaagccccacgagcgggcccaggtgttgcttcggtttgcggacgagatcgtcgcgcacgcgcaggagattgcgtttctggagatcttgacctccggcgcgacggtgcggcgcgtgtcgaacgccgacttgcttctcattgtcgatttgctccagcagaccgcgcggttcgcgcaggcgtacgaatacgcgaagacgcttccgctccggccgtttccgcagccgagccacaaccaggtatggagggagcccgtgggcgtgtgcgccgggatcacggcgtggaactatccactcttactcgcgatgtggaagctcgcgcccgcgctcgccatggggaactccatcgtgttgaaaccggcgtccaacacgccgctttccacgctcaagcttgccgagctcgcggcgaaggccgggctgccgaagggcgtgttcaacgtcgtcacggggccaggatcgtcggtgggcgaggcgctcgtcacgcacccggaggtcgacaaaatcgccttcaccggatccaccgaggtgggcaagcggatcatgcagctcgcggcgcagggcgtcaagcgcgtgaccctggagttgggcggcaagtcgccggccatcgtgctgccggacgcggacctggatctggcgatacccggcatcctgtttggcgtcttcctgcacgccgggcaggtgtgcgagtgcgggacgcgcgtgattgtccacgaggacatctacgaggaagtcgtgaatcgcctggccgagatggcctcgcagatcaagctcggcaatccgctcgatgacaaggtgggcatggggcccatcatctccgagtcgcagatgaacaccattctgagctacatcgagtcgggcaaggcggaaggcgcgcgcctcgtgtgcggcggccagcgcgccacgggaggcggcctggacgcaggttactttgtgcagccgaccatcttcgccgacgtcgacaaccgcatgaaaattgcgcaggaggagatcttcggccccgtgctcgcggtcatgaaggcgcgggacgtggacgaggcggttcggctggccaacgataccgtctatgggctggcgggcggcgtctggacgcgcgatctcaaccaggcctatcgcatcgcgcgcgagatccgggcggggaccatctgggtgaacgactggcacatgttccgcagcgacgcgccgttcggcggctacaagatgagcgggttcggccgcgagattgggccgtacgcgctcgacgaatacacgcagctcaagcacgtacacgcgtcgttcgtgcacgagctcgaaaaccgccattggtattccattgtgttgcccgacagggcctga

SEQ ID NO: 1241 - DNA, 1533 bp, Artificial
  Substituion in SEQ ID NO 1226
atggtcatgacgagtgtgagactccccgagtacggcatgttcatcgacggcgagtacacgcctgcggaaagcggggagatgttcgaggtggtgaatcccgccacggggcagccctgcgcgcgcgtggcgaagtcggacgcgcgagacgtggatcgcgccgtgcgaagcgctcgccgcgcgttcgagtcgggcgagtggtcccgcgccaagccccacgagcgggcccaggtgttgcttcggtttgcggacgagatcgtcgcgcacgcgcaggagattgcgtttctggagatcttgacctccggcgcgacggtgcggcgcgtgtcgaacgccgacttgcttctcattgtcgatttgctccagcagaccgcgcggttcgcgcaggcgtacgaatacgcgaagacgcttccgctccggccgtttccgcagccgagccacaaccaggtatggagggagcccgtgggcgtgtgcgccgggatcacggcgtggaactatccactcatcctcgcgatgtggaagctcgcgcccgcgctcgccatggggaactccatcgtgttgaaaccggcgtccaacacgccgctttccacgctcaagcttgccgagctcgcggcgaaggccgggctgccgaagggcgtgttcaacgtcgtcacggggccaggatcgtcggtgggcgaggcgctcgtcacgcacccggatgtcgacaaaatcgccttcaccggatccaccgaggtgggcaagcggatcatgcagctcgcggcgcagggcgtcaagcgcgtgaccctggagttgggcggcaagtcgccggccatcgtgctgccggacgcggacctggatctggcgatacccggcatcctgtttggcgtcttcctgcacgccgggcaggtgtgcgagtgcgggacgcgcgtgattgtccacgaggacatctacgaggaagtcgtgaatcgcctggccgagatggcctcgcagatcaagctcggcaatccgctcgatgacaaggtgggcatggggcccatcatctccgagtcgcagatgaacaccattctgagctacatcgagtcgggcaaggcggaaggcgcgcgcctcgtgtgcggcggccagcgcgccacgggaggcggcctggacgcaggttactttgtgcagccgaccatcttcgccgacgtcgacaaccgcatgaaaattgcgcaggaggagatcttcggccccgtgctcgcggtcatgaaggcgcgggacgtggacgaggcggttcggctggccaacgataccgtctatgggctggcgggcggcgtctggacgcgcgatctcaaccaggcctatcgcatcgcgcgcgagatccgggcggggaccatctgggtgaacgactggcacatgttccgcagcgacgcgccgttcggcggctacaagatgagcgggttcggccgcgagattgggccgtacgcgctcgacgaatacacgcagctcaagcacgtacacgcgtcgttcgtgcacgagctcgaaaaccgccattggtattccattgtgttgcccgacagggcctga

SEQ ID NO: 1242 - protein, 361 aa, Alicyclobacillus acidocaldarius
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKLRGEKRVAVTYTGDGGTSQGDFYEGMNFAGAMNLPVVFFVQNNQYAISVPRELQTRAQTLAQKAIAAGIPGVQVDGMDVLAVYHVMHEALERARNGEGPTMIEAVTFRYGPHTMSGDDPTRYRTKDVQEEWEKKDPLIRFRKYLEEKGLWSQEEEEAYIEEAKETVNNALKEADAAEKMTIPGLIDSMFEELTPTLKRQRAEFAGEEAN

SEQ ID NO: 1243 - DNA, 1086 bp, Alicyclobacillus acidocaldarius
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagctgcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgcgcaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 1244 - protein, 355 aa, Bacillus halodurans C-125
LEKVEGQFETFQILNEEGEVVNEAAMPDLSDEQLQELMKRMVYTRIWDQRAISLNRQGRLGFYAPVAGQEASMLGSQFALDKEDWILPGYRDIPQIVFHGLPLYQAFLYSRGHFEGGQIPDGVNVLMPQIIIGAQIVQAAGVAMGLKRKGKQNVAITYTGDGGASQGDFYEGMNFAGAYNSPAIFVVQNNRFAISVPVEKQSAAKTIAQKAVAAGIEGIQVDGMDVLAVYAATKQARERALAGDGPTLIETLCYRYGPHTMAGDDPTRYRSSDLDDEWEKKDPLVRFRKFLEGKGLWSEEQENEVVEKAKEDIKAAIKKADAAPKQKVTDLIGFMFEEAPQHLREQLEEYTAKES

SEQ ID NO: 1245 - protein, 349 aa, Geobacillus stearothermophilus
QFPTFQILNEEGEVVNEEAMPELSDEQLKELMRRMVYTRILDQRSISLNRQGRLGFYAPTAGQEASQIASHFALEKEDFILPGYRDVPQIIWHGLPLYQAFLFSRGHFHGNQIPEGVNVLPPQIIIGAQYIQAAGVALGLKMRGKKAVAITYTGDGGTSQGDFYEGINFAGAFKAPAIFVVQNNRFAISTPVEKQTVAKTLAQKAVAAGIPGIQVDGMDPLAVYAAVKAARERAINGEGPTLIETLCFRYGPHTMSGDDPTRYRSKELENEWAKKDPLVRFRKFLEAKGLWSEEEENNVIEQAKEEIKEAIKKADETPKQKVTDLISIMFEELPFNLKEQYEIYKEKES

SEQ ID NO: 1246 - protein, 349 aa, Geobacillus stearothermophilus; identical to SEQ ID NO: 1245

SEQ ID NO: 1247 - protein, 344 aa, Bacillus amyloliquefaciens FZB42
QILNAEGEVVNKDAMPDLSDDQLKELMRRMVYIRILDQRSISLSRQGRLGFYAPTAGQEASQIASHFALEQDDFILPGYRDVPQLIWHGLPLHQAFLFSRGHFKGNQMPEGVNALSPQIIIGAQIIQTAGVALGLKKRGKKAVAITYTGDGGASQGDFYEGMNFAGAFKAPAIFVVQNNRYAISTPVEKQSSAQTIAQKAVAVGITGVQVDGMDALAVYAATAEARQRAINGEGPTLIETLTFRYGPHTMSGDDPTKYRTKEIENEWEQKDPLVRFRKFLENKGLWSEEEENKVIEQAKEEIKQAIKKADGESKPKVTELIENMFEEPTFNLKEQLEIYKAKES

SEQ ID NO: 1248 - protein, 349 aa, Geobacillus kaustophilus HTA426
QFPTFQILNEEGEIVNEEAMPELSDEQLKELMRRMVYTRILDQRSISLNRQGRLGFYAPTAGQEASQIASHFALEKEDFILPGYRDVPQIIWHGLPLYQAFLFSRGHFHGNQIPEGVNVLPPQIIIGAQYIQAAGVALGLKMRGKKAVAITYTGDGGTSQGDFYEGINFAGAFKAPAIFVVQNNRFAISTPVEKQTIAKTLAQKAVAAGIPGIQVDGMDPLAVYAAVKAARERAINGEGPALIETLCFRYGPHTMSGDDPTRYRSKELENEWAKKDPLVRFRKFLEAKGLWSEEEENRVIEQAKEDIKEAIKKADETPKQKVTDLISIMFEELPANLKEQYEIYKEKES

SEQ ID NO: 1249 - protein, 361 aa, Artificial
  Substituion in SEQ ID NO 1242
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKLRGEKRVAVTYTGDGGTSQGDFYEGMNFAGAMNLPVVFFVQNNQYAISVPRELQTRAQTLAQKAIAAGIPGVQVDGMDVLAVYHVMHEALERARNGEGPTMIEAVTFRYGPHTMSGDDPTRYRTKDVQEEWEKKDPLIRFRKYLEEKGLWSQEEEEAYIEEAKETVNNALKEADAAEKMTIPGLIESMFEELTPTLKRQRAEFAGEEAN

SEQ ID NO: 1250 - protein, 361 aa, Artificial
  Substituion in SEQ ID NO 1242
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKLRGEKRVAVTYTGDGGTSQGDFYEGMNFAGAMNLPVVFFVQNNQYAISVPRELQTRAQTLAQKAIAAGIPGVQVDGMDVLAVYHVMHEALERARNGEGPTMIEAVTFRYGPHTMSGDDPTRYRTKDVQEEWEKKDPLIRFRKYLEDKGLWSQEEEEAYIEEAKETVNNALKEADAAEKMTIPGLIDSMFEELTPTLKRQRAEFAGEEAN

SEQ ID NO: 1251 - protein, 361 aa, Artificial
  Substituion in SEQ ID NO 1242
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKLRGEKRVAVTYTGDGGTSQGDFYEGMNFAGAMNLPVVFFVQNNQYAISVPRELQTRAQTLAQKAIAAGIPGVQVDGMDVLAVYHVMHEALERAKNGEGPTMIEAVTFRYGPHTMSGDDPTRYRTKDVQEEWEKKDPLIRFRKYLEEKGLWSQEEEEAYIEEAKETVNNALKEADAAEKMTIPGLIDSMFEELTPTLKRQRAEFAGEEAN

SEQ ID NO: 1252 - protein, 361 aa, Artificial
  Substituion in SEQ ID NO 1242
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKIRGEKRVAVTYTGDGGTSQGDFYEGMNFAGAMNLPVVFFVQNNQYAISVPRELQTRAQTLAQKAIAAGIPGVQVDGMDVLAVYHVMHEALERARNGEGPTMIEAVTFRYGPHTMSGDDPTRYRTKDVQEEWEKKDPLIRFRKYLEEKGLWSQEEEEAYIEEAKETVNNALKEADAAEKMTIPGLIDSMFEELTPTLKRQRAEFAGEEAN

SEQ ID NO: 1253 - protein, 361 aa, Artificial
  Substituion in SEQ ID NO 1242
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKLRGEKRVAVTYTGDGGTSQGDFYEGMNFAGAMNLPVVFFVQNNQYAISVPRELQTRAQTLAQKAIAAGIPGVQVDGMDVLAVYHVMHEALERARQGEGPTMIEAVTFRYGPHTMSGDDPTRYRTKDVQEEWEKKDPLIRFRKYLEEKGLWSQEEEEAYIEEAKETVNNALKEADAAEKMTIPGLIDSMFEELTPTLKRQRAEFAGEEAN

SEQ ID NO: 1254 - DNA, 1086 bp, Artificial
  Substituion in SEQ ID NO 1243
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagctgcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgcgcaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgaatcgatgttcgaagaactcaccccgacgctcaagcgccagcgggcggaatttgccggcgaggaggcgaactga

SEQ ID NO: 1255 - DNA, 1086 bp, Artificial
  Substituion in SEQ ID NO 1243
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagctgcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgcgcaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggataagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 1256 - DNA, 1086 bp, Artificial
  Substituion in SEQ ID NO 1243
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagctgcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgaaaaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 1257 - DNA, 1086 bp, Artificial
  Substituion in SEQ ID NO 1243
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagattcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgcgcaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 1258 - DNA, 1086 bp, Artificial
  Substituion in SEQ ID NO 1243
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagctgcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgcgccaaggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 1259 - protein, 334 aa, Alicyclobacillus acidocaldarius
MPARRRTDMAQMTMIQAITHALDLELARDERVLVFGEDVGKNGGVFRATEGLQQKYGPNRVFDTPLAESGIIGLANGLAIQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHVALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 1260 - DNA, 1005 bp, Alicyclobacillus acidocaldarius
ttgccggcgaggaggcgaactgacatggcgcagatgacgatgattcaggcgatcacgcacgccctcgatctcgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 1261 - protein, 324 aa, Bacillus coagulans 36D1
MAQLTMIQAITDALRTELKNDENVLVFGEDVGVNGGVFRATEGLQKEFGKDRVIDTPLAESGINGLAIGLALQGFRPVPEIQFFGFVFETMDSIHGQMARYRFRTGGDLKMPITIRAPFGGGVHTPEMHADSLEGLMAQTPGIKVVIPSTPYDAKGLLISAIRDNDPVVFLEHMKLYRSFREEVPEEEYTIPLGKADVKREGKDISIIAYGAMVHESLKAADELEKEGYSAEVVDLRTVSPLDVETIVASVEKTNRAIVVQEAQRQAGVAANVVAEINERAILSLEAPVLRVTAPDTVYPFSQAEGVWIPTYKDILEKAKETLT

SEQ ID NO: 1262 - protein, 324 aa, Geobacillus stearothermophilus
MAQMTMVQAITDALRIELKNDPNVLIFGEDVGVNGGVFRATEGLQAEFGEDRVFDTPLAESGIGGLAIGLALQGFRPVPEIQFFGFVYEVMDSICGQMARIRYRTGGRYHMPITIRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVMN

SEQ ID NO: 1263 - protein, 324 aa, Geobacillus thermodenitrificans NG80-2
MAQMTMVQAITDALRIELKNDPNVLIFGEDVGVNGGVFRATEGLQAEFGEERVFDTPLAESGIGGLAVGLALQGFRPVPEIQFFGFVYEVMDSISGQMARIRYRTGGRYHMPITVRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVMN

SEQ ID NO: 1264 - protein, 323 aa, Geobacillus stearothermophilus
AQMTMVQAITDALRIELKNDPNVLIFGEDVGVNGGVFRATEGLQAEFGEDRVFDTPLAESGIGGLAIGLALQGFRPVPEIQFFGFVYEVMDSICGQMARIRYRTGGRYHMPITIRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVMN

SEQ ID NO: 1265 - protein, 324 aa, Geobacillus kaustophilus HTA426
MAQMTMVQAITDALRIEMRNDPNVLVFGEDVGVNGGVFRVTEGLQAEFGEERVFDTPLAESGIGGLAIGLALQGFRPVPEIQFFGFVYEAMDAICGQMARIRYRTGGRYHVPITIRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVIN

SEQ ID NO: 1266 - protein, 334 aa, Artificial
  Substituion in SEQ ID NO 1259
MPARKRTDMAQMTMIQAITHALDLELARDERVLVFGEDVGKNGGVFRATEGLQQKYGPNRVFDTPLAESGIIGLANGLAIQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHVALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 1267 - protein, 334 aa, Artificial
  Substituion in SEQ ID NO 1259
MPARRRTDMAQMTMIQAITHALDIELARDERVLVFGEDVGKNGGVFRATEGLQQKYGPNRVFDTPLAESGIIGLANGLAIQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHVALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 1268 - protein, 334 aa, Artificial
  Substituion in SEQ ID NO 1259
MPARRRTDMAQMTMIQAITHALDLELARDERVLVFGEDVGKNGGVFRATEGLQQKYGPNRVFDTPLAESGIIGLANGLAIQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHIALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 1269 - protein, 334 aa, Artificial
  Substituion in SEQ ID NO 1259
MPARRRTDMAQMTMIQAITHALDLELARDERVLVFGEDVGKNGGVFRATEGLQQKYGPNRVFDTPLAESGIIGLANGLAIQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHVALKAAEQWSKERGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 1270 - protein, 334 aa, Artificial
  Substituion in SEQ ID NO 1259
MPARRRTDMAQMTMIQAITHALDLELARDERVLVFGEDVGKNGGVFRATEGLQQKYGPNRVFDTPLAESGIIGLANGLAIQGFRPVPEIQFFGFVFEAFDQIAGQLARTRYRTGGKYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHVALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 1271 - DNA, 1005 bp, Artificial
  Substituion in SEQ ID NO 1260
ttgccggcgaggaaacgaactgacatggcgcagatgacgatgattcaggcgatcacgcacgccctcgatctcgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 1272 - DNA, 1005 bp, Artificial
  Substituion in SEQ ID NO 1260
ttgccggcgaggaggcgaactgacatggcgcagatgacgatgattcaggcgatcacgcacgccctcgatattgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 1273 - DNA, 1005 bp, Artificial
  Substituion in SEQ ID NO 1260
ttgccggcgaggaggcgaactgacatggcgcagatgacgatgattcaggcgatcacgcacgccctcgatctcgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacattgcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 1274 - DNA, 1005 bp, Artificial
  Substituion in SEQ ID NO 1260
ttgccggcgaggaggcgaactgacatggcgcagatgacgatgattcaggcgatcacgcacgccctcgatctcgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaacgtggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 1275 - DNA, 1005 bp, Artificial
  Substituion in SEQ ID NO 1260
ttgccggcgaggaggcgaactgacatggcgcagatgacgatgattcaggcgatcacgcacgccctcgatctcgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggcaaatacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 1276 - protein, 470 aa, Alicyclobacillus acidocaldarius
MVVGDIVEEVEVLVIGAGPGGYVAAIRAAQLGKSVTIVDKAELGGVCLNRGCIPSKALISAAHHYEAAKESPFPGIETTATFDFKKVQEWKQSVVKKMTSGVQQLLKGNKVNVIHGEAFFTKPNEVRVMQENGSQRLQFQHCILATGSRPIELKNLPLGKRVIDSTGALSLDHVPKRLVVVGGGYIGIELGQTFAKFGSQVTIIEGLDSILALFDKQMVRLVEKNLKKYNVQIETNALAQGVEETEDGVKLTYKDKDGNEKTIEADYVLVTVGRRPNTDEIGLQDAGIELTDKGLVKVDQQCRTTNPNVFAIGDIVPGPALAHKASYEGKVAAEVIAGKPSIVDYRCIPSVVFSDPEMASVGLTEEEAKKEYGQVAVGRFPYAANGRATALNATDGFIKLVANKENGVLVGAQVVGVEASNIIAELGLAIEMSATLEDIALTIHAHPTLGEMVMEAAEVGLGEPIHIIKG

SEQ ID NO: 1277 - DNA, 1413 bp, Alicyclobacillus acidocaldarius
atggtagtcggagatattgtggaagaggttgaggtcctcgtcattggcgcaggccctggcggttacgtggcagccattcgggctgcgcagctcgggaagtcggtcaccattgtggacaaggccgagctgggcggcgtgtgcctgaaccgcggttgcattccttccaaggcgctcatctcggccgcccatcactacgaggcggccaaggagtcgccgttcccgggcatcgagacgaccgcaaccttcgatttcaagaaagtgcaggaatggaagcagtcggttgtcaaaaagatgacgagcggcgtacagcagctcctgaaggggaacaaggtcaacgtcatccacggcgaagcatttttcaccaagccgaacgaagtgcgcgtcatgcaggagaacggcagccagcggctgcagttccaacactgcatcctggcgaccggctcgcggcccatcgagctgaagaatttgccgcttggcaagcgcgtgattgactcgaccggcgcgctctcgctcgatcacgtcccgaagcggctggtcgtggtgggcggcggttacatcggcatcgagctcggccagacgttcgccaagttcggaagccaggtgaccatcatcgagggcctggacagcatcctcgcgctctttgacaagcagatggtccgccttgtggaaaagaacctgaagaagtacaacgtgcagattgagaccaacgcgctcgcgcagggcgtggaggagaccgaggacggcgtcaagctcacctacaaggacaaagacggcaacgagaagaccattgaggcggactacgtcctcgtgacagtgggtcgccgcccgaacacggacgagatcggcctgcaggacgcgggcatcgagctgacggacaagggcctcgtcaaggtcgatcagcagtgccgcaccaccaacccgaacgtcttcgccatcggggacatcgtgcctggcccggcgctcgcccacaaggcgtcgtacgaaggcaaggtggccgcggaggtcatcgcgggcaagccgtccatcgtcgactaccgctgcatcccgtccgtcgtcttctcggatccggagatggcgtcggtcggcctgaccgaggaagaggcgaagaaggagtacggccaggttgcggtcggccgcttcccgtacgccgccaacgggcgtgcgacggcgctcaacgcgaccgacggcttcatcaagctcgtcgccaacaaggagaacggcgtgctcgtcggcgcccaggtggttggcgtcgaggcgtcgaacatcatcgcggagctcgggcttgccatcgagatgagcgcaacgctcgaggacatcgcgctgaccattcacgcccatcccacgctcggagagatggtcatggaagccgccgaagtcggcctcggcgagccgattcacatcatcaagggataa

SEQ ID NO: 1278 - protein, 468 aa, Geobacillus thermodenitrificans NG80-2
MVVGDFAIETETLVVGAGPGGYVAAIRAAQLGQKVTIVEKANLGGVCLNVGCIPSKALISAGHRYEQAKHSEEMGIKAENVTVDFSKVQEWKASVVKKLTGGVEGLLKGNKVEIVKGEAYFVDANTVRVVNGDSAQTYTFKNAIIATGSRPIELPNFKFSNRILDSTGALNLGEIPKSLVVIGGGYIGIELGTAYANFGAKVTILEGAGEILSGFEKQMAAIIKRRLKKKGVDIVTNALAKGAEEREDGVTVTYEANGETKTVDADYVLVTVGRRPNTDELGLEQVGIKMTDRGLIEVDQQCRTSVPNIFAIGDIVPGPALAHKASYEGKVAAEAIAGHPSVVDYVAIPAVVFSDPECASVGYFEQQAKDEGIDVITAKFPFAANGRALALNDTDGFLKLVVRKEDGVVIGAQIIGPNASDMIAELGLAIEAGMTAEDIALTIHAHPTLGEIAMEGAEVALGTPIHII

SEQ ID NO: 1279 - protein, 468 aa, Geobacillus stearothermophilus
MVVGDFAIETETLVVGAGPGGYVAAIRAAQLGQKVTIVEKGNLGGVCLNVGCIPSKALISASHRYEQAKHSEEMGIKAENVTIDFAKVQEWKASVVKKLTGGVEGLLKGNKVEIVKGEAYFVDANTVRVVNGDSAQTYTFKNAIIATGSRPIELPNFKFSNRILDSTGALNLGEVPKSLVVIGGGYIGIELGTAYANFGTKVTILEGAGEILSGFEKQMAAIIKKRLKKKGVEVVTNALAKGAEEREDGVTVTYEANGETKTIDADYVLVTVGRRPNTDELGLEQIGIKMTNRGLIEVDQQCRTSVPNIFAIGDIVPGPALAHKASYEGKVAAEAIAGHPSAVDYVAIPAVVFSDPECASVGYFEQQAKDEGIDVIAAKFPFAANGRALALNDTDGFLKLVVRKEDGVIIGAQIIGPNASDMIAELGLAIEAGMTAEDIALTIHAHPTLGEIAMEAAEVALGTPIHII

SEQ ID NO: 1280 - protein, 468 aa, Geobacillus kaustophilus HTA426
MVVGDFAIETETLVVGAGPGGYVAAIRAAQLGQKVTIVEKGNLGGVCLNVGCIPSKALISASHRYEQAKHSEEMGIKAENVTVDFSKVQEWKASIVKKLTGGVEGLLKGNKVDIVKGEAYFVDANTVRVVNGDSAQTYTFKNAILATGSRPIELPNFKFSGRILDSTGALNLGEIPKSLVVIGGGYIGIELGTAYANFGAKVTILEGAGEILSGFEKQMVSIIKRRLKNKGVEVVTNALAKGAEERADGVTVTYEANGETKTIDADYVLVTVGRRPNTDELGLEQIGIKMTNRGLIEVDQQCRTSVPNIFAIGDIVPGPALAHKASYEGKVAAEAIAGHPSVVDYIAIPAVVFSDPECASVGYFEQQAKEEGIDVITAKFPFAANGRALSLNDTDGFLKLVVRKEDGVVIGAQIIGPNASDMIAELGLAIEAGMTAEDIALTIHAHPTLGEIAMEAAEVALGTPIHII

SEQ ID NO: 1281 - protein, 470 aa, Bacillus pumilus SAFR-032
MVVGDFPIETDTLVIGAGPGGYVAAIRAAQLGQKVTIVEKGTLGGVCLNVGCIPSKALINAGHRFENAKHSEDMGIKAENVTVDFTKVQEWKASVVNKLTGGVQGLLKGNKVDIVKGEAYFVDSNSVRVMDENSAQTYTFKNAILATGSRPIELPTFKYTDRVINSTGALALKEVPKKLVVIGGGYIGTELGTAYANFGTEVVILEGGDEILPGFEKQMSSLVKRNLKKKGNVEIHTNALAKGVEEKSDGVTVTFEVKGEEKTVDADYVLVTVGRRPNTDELGLEQVGVELTDRGVVKTDKQCRTSVSNIYAIGDIVDGPPLAHKASYEGKIAAEAIAGEPAEIDYLGIPAVVFSEPELATVGYTEAEAKEEGIDIVAAKFPFAANGRALSLDATDGFMKMITRKEDGLVIGAQIAGVGASDMISELSLAIEAGVTAEDIAMTIHAHPTLGEITMETAEVAIGSPIHIVK

SEQ ID NO: 1282 - protein, 453 aa, Geobacillus stearothermophilus
ETETLVVGAGPGGYVAAIRAAQLGQKVTIVEKGNLGGVCLNVGCIPSKALISASHRYEQAKHSEEMGIKAENVTIDFAKVQEWKASVVKKLTGGVEGLLKGNKVEIVKGEAYFVDANTVRVVNGDSAQTYTFKNAIIATGSRPIELPNFKFSNRILDSTGALNLGEVPKSLVVIGGGYIGIELGTAYANFGTKVTILEGAGEILSGFEKQMAAIIKKRLKKKGVEVVTNALAKGAEEREDGVTVTYEANGETKTIDADYVLVTVGRRPNTDELGLEQIGIKMTNRGLIEVDQQCRTSVPNIFAIGDIVPGPALAHKASYEGKVAAEAIAGHPSAVDYVAIPAVVFSDPECASVGYFEQQAKDEGIDVIAAKFPFAANGRALALNDTDGFLKLVVRKEDGVIIGAQIIGPNASDMIAELGLAIEAGMTAEDIALTIHAHPTLGEIAMEAAEVAL

SEQ ID NO: 1283 - protein, 470 aa, Artificial
  Substituion in SEQ ID NO 1276
MVVGDIVEEVEVLVIGAGPGGYVAAIRAAQLGKSVTIVDKAELGGVCLNRGCIPSKALISAAHHYEAAKESPFPGIETTATFDFKKVQEWKQSVVKKMTSGVQQLLKGNKVNVIHGEAFFTKPNEVRVMQENGSQRLQFQHCILATGSRPIELKNLPLGKRVIDSTGALSLDHVPKRLVVVGGGYIGIELGQTFAKFGSQVTIIEGLDSILALFDKQMVRLVEKNLKKYNVQIETNALAQGVEETEDGVKLTYKDKDGNEKTIEADYVLVTVGRRPNTDEIGLQDAGIELTDKGLVKVDQQCRTTNPNVFAIGDIVPGPALAHKASYEGKVAAEVIAGKPSIVDYRCIPSVVFSDPEMASVGLTEEEAKKEYGQVAVGRFPYAANGRATALNATDGFIKLVANKENGVLVGAQVVGVEASNIIAELGLAIEMSATLEDIALTIHAHPTLGEMVMEAAEVGLGEPLHIIKG

SEQ ID NO: 1284 - protein, 470 aa, Artificial
  Substituion in SEQ ID NO 1276
MVVGDIVEEVEVLVIGAGPGGYVAAIRAAQLGKSVTIVDKAELGGVCLNKGCIPSKALISAAHHYEAAKESPFPGIETTATFDFKKVQEWKQSVVKKMTSGVQQLLKGNKVNVIHGEAFFTKPNEVRVMQENGSQRLQFQHCILATGSRPIELKNLPLGKRVIDSTGALSLDHVPKRLVVVGGGYIGIELGQTFAKFGSQVTIIEGLDSILALFDKQMVRLVEKNLKKYNVQIETNALAQGVEETEDGVKLTYKDKDGNEKTIEADYVLVTVGRRPNTDEIGLQDAGIELTDKGLVKVDQQCRTTNPNVFAIGDIVPGPALAHKASYEGKVAAEVIAGKPSIVDYRCIPSVVFSDPEMASVGLTEEEAKKEYGQVAVGRFPYAANGRATALNATDGFIKLVANKENGVLVGAQVVGVEASNIIAELGLAIEMSATLEDIALTIHAHPTLGEMVMEAAEVGLGEPIHIIKG

SEQ ID NO: 1285 - protein, 470 aa, Artificial
  Substituion in SEQ ID NO 1276
MVVGDIVEEVEVLVIGAGPGGYVAAIRAAQLGKSVTIVDKAELGGVCLNRGCIPSKALISAAHHYEAAKESPFPGIETTATFDFKKVQEWKQSVVKKMTSGVQQLLKGNKVNVIHGEAFFTKPNEVRVMQENGSQRLQFQHCILATGSRPIELKNLPLGKRVIDSTGALSLDHVPKRLVVVGGGYIGIELGQTFAKFGSQVTIIEGLDSILALFDKQMIRLVEKNLKKYNVQIETNALAQGVEETEDGVKLTYKDKDGNEKTIEADYVLVTVGRRPNTDEIGLQDAGIELTDKGLVKVDQQCRTTNPNVFAIGDIVPGPALAHKASYEGKVAAEVIAGKPSIVDYRCIPSVVFSDPEMASVGLTEEEAKKEYGQVAVGRFPYAANGRATALNATDGFIKLVANKENGVLVGAQVVGVEASNIIAELGLAIEMSATLEDIALTIHAHPTLGEMVMEAAEVGLGEPIHIIKG

SEQ ID NO: 1286 - protein, 470 aa, Artificial
  Substituion in SEQ ID NO 1276
MVVGDIVEEVEVLVIGAGPGGYVAAIRAAQLGKSVTIVDKAELGGVCLNRGCIPSKALISAAHHYEAAKESPFPGIETTATFDFKKVQEWKQSVVKKMTSGVQQLLKGNKVNVIHGEAFFTKPNEVRVMQENGSQRLQFQHCILATGSRPIELKNLPLGKRVIDSTGALSLDHVPKRLVVVGGGYIGIELGQTFAKFGSQVTIIEGLDSILALFDKQMVRLVEKNLKKYNVQIDTNALAQGVEETEDGVKLTYKDKDGNEKTIEADYVLVTVGRRPNTDEIGLQDAGIELTDKGLVKVDQQCRTTNPNVFAIGDIVPGPALAHKASYEGKVAAEVIAGKPSIVDYRCIPSVVFSDPEMASVGLTEEEAKKEYGQVAVGRFPYAANGRATALNATDGFIKLVANKENGVLVGAQVVGVEASNIIAELGLAIEMSATLEDIALTIHAHPTLGEMVMEAAEVGLGEPIHIIKG

SEQ ID NO: 1287 - protein, 470 aa, Artificial
  Substituion in SEQ ID NO 1276
MVVGDIVEEVEVLVIGAGPGGYVAAIRAAQLGKSVTIVDKAELGGVCLNRGCIPSKALISAAHHYEAAKESPFPGIETTATFDFKKVQEWKQSVVKKMTSGVQQLLKGNKVNVIHGEAFFTKPNEVRVMQENGSQRLQFQHCILATGSRPIELKNLPIGKRVIDSTGALSLDHVPKRLVVVGGGYIGIELGQTFAKFGSQVTIIEGLDSILALFDKQMVRLVEKNLKKYNVQIETNALAQGVEETEDGVKLTYKDKDGNEKTIEADYVLVTVGRRPNTDEIGLQDAGIELTDKGLVKVDQQCRTTNPNVFAIGDIVPGPALAHKASYEGKVAAEVIAGKPSIVDYRCIPSVVFSDPEMASVGLTEEEAKKEYGQVAVGRFPYAANGRATALNATDGFIKLVANKENGVLVGAQVVGVEASNIIAELGLAIEMSATLEDIALTIHAHPTLGEMVMEAAEVGLGEPIHIIKG

SEQ ID NO: 1288 - DNA, 1413 bp, Artificial
  Substituion in SEQ ID NO 1277
atggtagtcggagatattgtggaagaggttgaggtcctcgtcattggcgcaggccctggcggttacgtggcagccattcgggctgcgcagctcgggaagtcggtcaccattgtggacaaggccgagctgggcggcgtgtgcctgaaccgcggttgcattccttccaaggcgctcatctcggccgcccatcactacgaggcggccaaggagtcgccgttcccgggcatcgagacgaccgcaaccttcgatttcaagaaagtgcaggaatggaagcagtcggttgtcaaaaagatgacgagcggcgtacagcagctcctgaaggggaacaaggtcaacgtcatccacggcgaagcatttttcaccaagccgaacgaagtgcgcgtcatgcaggagaacggcagccagcggctgcagttccaacactgcatcctggcgaccggctcgcggcccatcgagctgaagaatttgccgcttggcaagcgcgtgattgactcgaccggcgcgctctcgctcgatcacgtcccgaagcggctggtcgtggtgggcggcggttacatcggcatcgagctcggccagacgttcgccaagttcggaagccaggtgaccatcatcgagggcctggacagcatcctcgcgctctttgacaagcagatggtccgccttgtggaaaagaacctgaagaagtacaacgtgcagattgagaccaacgcgctcgcgcagggcgtggaggagaccgaggacggcgtcaagctcacctacaaggacaaagacggcaacgagaagaccattgaggcggactacgtcctcgtgacagtgggtcgccgcccgaacacggacgagatcggcctgcaggacgcgggcatcgagctgacggacaagggcctcgtcaaggtcgatcagcagtgccgcaccaccaacccgaacgtcttcgccatcggggacatcgtgcctggcccggcgctcgcccacaaggcgtcgtacgaaggcaaggtggccgcggaggtcatcgcgggcaagccgtccatcgtcgactaccgctgcatcccgtccgtcgtcttctcggatccggagatggcgtcggtcggcctgaccgaggaagaggcgaagaaggagtacggccaggttgcggtcggccgcttcccgtacgccgccaacgggcgtgcgacggcgctcaacgcgaccgacggcttcatcaagctcgtcgccaacaaggagaacggcgtgctcgtcggcgcccaggtggttggcgtcgaggcgtcgaacatcatcgcggagctcgggcttgccatcgagatgagcgcaacgctcgaggacatcgcgctgaccattcacgcccatcccacgctcggagagatggtcatggaagccgccgaagtcggcctcggcgagccgttacacatcatcaagggataa

SEQ ID NO: 1289 - DNA, 1413 bp, Artificial
  Substituion in SEQ ID NO 1277
atggtagtcggagatattgtggaagaggttgaggtcctcgtcattggcgcaggccctggcggttacgtggcagccattcgggctgcgcagctcgggaagtcggtcaccattgtggacaaggccgagctgggcggcgtgtgcctgaacaaaggttgcattccttccaaggcgctcatctcggccgcccatcactacgaggcggccaaggagtcgccgttcccgggcatcgagacgaccgcaaccttcgatttcaagaaagtgcaggaatggaagcagtcggttgtcaaaaagatgacgagcggcgtacagcagctcctgaaggggaacaaggtcaacgtcatccacggcgaagcatttttcaccaagccgaacgaagtgcgcgtcatgcaggagaacggcagccagcggctgcagttccaacactgcatcctggcgaccggctcgcggcccatcgagctgaagaatttgccgcttggcaagcgcgtgattgactcgaccggcgcgctctcgctcgatcacgtcccgaagcggctggtcgtggtgggcggcggttacatcggcatcgagctcggccagacgttcgccaagttcggaagccaggtgaccatcatcgagggcctggacagcatcctcgcgctctttgacaagcagatggtccgccttgtggaaaagaacctgaagaagtacaacgtgcagattgagaccaacgcgctcgcgcagggcgtggaggagaccgaggacggcgtcaagctcacctacaaggacaaagacggcaacgagaagaccattgaggcggactacgtcctcgtgacagtgggtcgccgcccgaacacggacgagatcggcctgcaggacgcgggcatcgagctgacggacaagggcctcgtcaaggtcgatcagcagtgccgcaccaccaacccgaacgtcttcgccatcggggacatcgtgcctggcccggcgctcgcccacaaggcgtcgtacgaaggcaaggtggccgcggaggtcatcgcgggcaagccgtccatcgtcgactaccgctgcatcccgtccgtcgtcttctcggatccggagatggcgtcggtcggcctgaccgaggaagaggcgaagaaggagtacggccaggttgcggtcggccgcttcccgtacgccgccaacgggcgtgcgacggcgctcaacgcgaccgacggcttcatcaagctcgtcgccaacaaggagaacggcgtgctcgtcggcgcccaggtggttggcgtcgaggcgtcgaacatcatcgcggagctcgggcttgccatcgagatgagcgcaacgctcgaggacatcgcgctgaccattcacgcccatcccacgctcggagagatggtcatggaagccgccgaagtcggcctcggcgagccgattcacatcatcaagggataa

SEQ ID NO: 1290 - DNA, 1413 bp, Artificial
  Substituion in SEQ ID NO 1277
atggtagtcggagatattgtggaagaggttgaggtcctcgtcattggcgcaggccctggcggttacgtggcagccattcgggctgcgcagctcgggaagtcggtcaccattgtggacaaggccgagctgggcggcgtgtgcctgaaccgcggttgcattccttccaaggcgctcatctcggccgcccatcactacgaggcggccaaggagtcgccgttcccgggcatcgagacgaccgcaaccttcgatttcaagaaagtgcaggaatggaagcagtcggttgtcaaaaagatgacgagcggcgtacagcagctcctgaaggggaacaaggtcaacgtcatccacggcgaagcatttttcaccaagccgaacgaagtgcgcgtcatgcaggagaacggcagccagcggctgcagttccaacactgcatcctggcgaccggctcgcggcccatcgagctgaagaatttgccgcttggcaagcgcgtgattgactcgaccggcgcgctctcgctcgatcacgtcccgaagcggctggtcgtggtgggcggcggttacatcggcatcgagctcggccagacgttcgccaagttcggaagccaggtgaccatcatcgagggcctggacagcatcctcgcgctctttgacaagcagatgattcgccttgtggaaaagaacctgaagaagtacaacgtgcagattgagaccaacgcgctcgcgcagggcgtggaggagaccgaggacggcgtcaagctcacctacaaggacaaagacggcaacgagaagaccattgaggcggactacgtcctcgtgacagtgggtcgccgcccgaacacggacgagatcggcctgcaggacgcgggcatcgagctgacggacaagggcctcgtcaaggtcgatcagcagtgccgcaccaccaacccgaacgtcttcgccatcggggacatcgtgcctggcccggcgctcgcccacaaggcgtcgtacgaaggcaaggtggccgcggaggtcatcgcgggcaagccgtccatcgtcgactaccgctgcatcccgtccgtcgtcttctcggatccggagatggcgtcggtcggcctgaccgaggaagaggcgaagaaggagtacggccaggttgcggtcggccgcttcccgtacgccgccaacgggcgtgcgacggcgctcaacgcgaccgacggcttcatcaagctcgtcgccaacaaggagaacggcgtgctcgtcggcgcccaggtggttggcgtcgaggcgtcgaacatcatcgcggagctcgggcttgccatcgagatgagcgcaacgctcgaggacatcgcgctgaccattcacgcccatcccacgctcggagagatggtcatggaagccgccgaagtcggcctcggcgagccgattcacatcatcaagggataa

SEQ ID NO: 1291 - DNA, 1413 bp, Artificial
  Substituion in SEQ ID NO 1277
atggtagtcggagatattgtggaagaggttgaggtcctcgtcattggcgcaggccctggcggttacgtggcagccattcgggctgcgcagctcgggaagtcggtcaccattgtggacaaggccgagctgggcggcgtgtgcctgaaccgcggttgcattccttccaaggcgctcatctcggccgcccatcactacgaggcggccaaggagtcgccgttcccgggcatcgagacgaccgcaaccttcgatttcaagaaagtgcaggaatggaagcagtcggttgtcaaaaagatgacgagcggcgtacagcagctcctgaaggggaacaaggtcaacgtcatccacggcgaagcatttttcaccaagccgaacgaagtgcgcgtcatgcaggagaacggcagccagcggctgcagttccaacactgcatcctggcgaccggctcgcggcccatcgagctgaagaatttgccgcttggcaagcgcgtgattgactcgaccggcgcgctctcgctcgatcacgtcccgaagcggctggtcgtggtgggcggcggttacatcggcatcgagctcggccagacgttcgccaagttcggaagccaggtgaccatcatcgagggcctggacagcatcctcgcgctctttgacaagcagatggtccgccttgtggaaaagaacctgaagaagtacaacgtgcagattgataccaacgcgctcgcgcagggcgtggaggagaccgaggacggcgtcaagctcacctacaaggacaaagacggcaacgagaagaccattgaggcggactacgtcctcgtgacagtgggtcgccgcccgaacacggacgagatcggcctgcaggacgcgggcatcgagctgacggacaagggcctcgtcaaggtcgatcagcagtgccgcaccaccaacccgaacgtcttcgccatcggggacatcgtgcctggcccggcgctcgcccacaaggcgtcgtacgaaggcaaggtggccgcggaggtcatcgcgggcaagccgtccatcgtcgactaccgctgcatcccgtccgtcgtcttctcggatccggagatggcgtcggtcggcctgaccgaggaagaggcgaagaaggagtacggccaggttgcggtcggccgcttcccgtacgccgccaacgggcgtgcgacggcgctcaacgcgaccgacggcttcatcaagctcgtcgccaacaaggagaacggcgtgctcgtcggcgcccaggtggttggcgtcgaggcgtcgaacatcatcgcggagctcgggcttgccatcgagatgagcgcaacgctcgaggacatcgcgctgaccattcacgcccatcccacgctcggagagatggtcatggaagccgccgaagtcggcctcggcgagccgattcacatcatcaagggataa

SEQ ID NO: 1292 - DNA, 1413 bp, Artificial
  Substituion in SEQ ID NO 1277
atggtagtcggagatattgtggaagaggttgaggtcctcgtcattggcgcaggccctggcggttacgtggcagccattcgggctgcgcagctcgggaagtcggtcaccattgtggacaaggccgagctgggcggcgtgtgcctgaaccgcggttgcattccttccaaggcgctcatctcggccgcccatcactacgaggcggccaaggagtcgccgttcccgggcatcgagacgaccgcaaccttcgatttcaagaaagtgcaggaatggaagcagtcggttgtcaaaaagatgacgagcggcgtacagcagctcctgaaggggaacaaggtcaacgtcatccacggcgaagcatttttcaccaagccgaacgaagtgcgcgtcatgcaggagaacggcagccagcggctgcagttccaacactgcatcctggcgaccggctcgcggcccatcgagctgaagaatttgccgattggcaagcgcgtgattgactcgaccggcgcgctctcgctcgatcacgtcccgaagcggctggtcgtggtgggcggcggttacatcggcatcgagctcggccagacgttcgccaagttcggaagccaggtgaccatcatcgagggcctggacagcatcctcgcgctctttgacaagcagatggtccgccttgtggaaaagaacctgaagaagtacaacgtgcagattgagaccaacgcgctcgcgcagggcgtggaggagaccgaggacggcgtcaagctcacctacaaggacaaagacggcaacgagaagaccattgaggcggactacgtcctcgtgacagtgggtcgccgcccgaacacggacgagatcggcctgcaggacgcgggcatcgagctgacggacaagggcctcgtcaaggtcgatcagcagtgccgcaccaccaacccgaacgtcttcgccatcggggacatcgtgcctggcccggcgctcgcccacaaggcgtcgtacgaaggcaaggtggccgcggaggtcatcgcgggcaagccgtccatcgtcgactaccgctgcatcccgtccgtcgtcttctcggatccggagatggcgtcggtcggcctgaccgaggaagaggcgaagaaggagtacggccaggttgcggtcggccgcttcccgtacgccgccaacgggcgtgcgacggcgctcaacgcgaccgacggcttcatcaagctcgtcgccaacaaggagaacggcgtgctcgtcggcgcccaggtggttggcgtcgaggcgtcgaacatcatcgcggagctcgggcttgccatcgagatgagcgcaacgctcgaggacatcgcgctgaccattcacgcccatcccacgctcggagagatggtcatggaagccgccgaagtcggcctcggcgagccgattcacatcatcaagggataa

SEQ ID NO: 1293 - protein, 502 aa, Alicyclobacillus acidocaldarius
MSIRPDEISALIKQQIEQFEVKAEVRDTGTVLSVGDGIARLYGLDNVMAGELVEFESGVYGMALNLEEDNVGVVVLGSVQGIREGEQVRRTGRLVTVPVGPQLLGRVVNALGQPIDNKGPIEATEYRPVESPAPGVIVRRSVHEPLETGIKAIDSMVPIGRGQRELIIGDRQTGKTAIALDTIINQKGKDVKCIYVAIGQKQSTVAQVVETLRRYGAMEYTTVVVASASEPAPLLFLAPYAGCAMAEYYLYNGQHALVVYDDLSKQAAAYREMSLLLRRPPGREAYPGDVFYLHSRLLERAAKLNDEHGGGSLTALPFIETQAGDISAYIPTNVISITDGQIFLESDLFFAGVRPAINVGSSVSRVGSAAQTKAMKKVAGTLKLDLAQYRELQAFTQFGSDLDKATQDTLRRGERMTELLKQPQYHPLTFDRQVASLWTGVNGYLDDIPVEAVQKFEREWLAFLDREYPQVFQQMQERKSLEDDTIELMKEAMAKFKPTFVP

SEQ ID NO: 1294 - DNA, 1509 bp, Alicyclobacillus acidocaldarius
ttgagcattcgtccggatgaaatcagcgcgctcatcaagcaacagatcgagcagttcgaggtcaaggccgaggtgcgcgacacgggcacggtgctgtcggtgggcgacggcattgcgcgcctctatggcttggacaacgtcatggcgggcgaactggtcgagttcgaaagcggcgtgtacggcatggcgctgaacctggaggaggacaacgtcggcgtcgtggtgctcgggtccgtgcagggcatccgcgaaggcgaacaggtgcgccgcaccggacgcttggtcacggtgccggtgggtccgcagctcttggggcgcgtcgtgaacgcgctgggtcaacccattgacaataagggccccattgaggccacggagtatcgtcccgtcgagtcgccggcgccgggcgtcatcgtgcgccgctctgtgcacgagccgctcgagacgggcatcaaggccatcgactcgatggtgcccatcggacgcggtcagcgcgagctgatcatcggcgaccgccagacggggaaaacggccattgcgctcgacaccatcatcaaccaaaagggcaaggacgtgaagtgcatctacgtcgccatcgggcagaagcagtccacggtggcgcaagtcgtggagacgcttcgccgctacggcgcgatggagtacaccaccgtggtcgtggcgagcgcttcggagcccgctccgctcctgttcctcgctccctacgccgggtgcgcgatggcggagtactacctgtacaacgggcagcacgcgctcgtggtgtacgacgacctgtcgaagcaggccgcggcataccgcgagatgtcgctcttgctgcgccgcccgccgggccgcgaggcgtatccgggagacgtgttctatctgcattcgcgcctcttggagcgcgccgcgaagctgaacgacgagcacggcggcggttcgctcacggccctgccgttcattgagacgcaggcgggcgacatctccgcgtacatcccgaccaacgtcatctcgatcacggacggccagatcttcctcgagtcggatctgttcttcgcgggcgtgcggccggccatcaacgtcggatcgtcggtgtcccgcgtgggctccgccgcgcagacgaaggccatgaagaaggtcgcgggcacgctgaagctcgatctcgcccagtaccgcgagctccaggccttcacccagttcggcagcgatctggacaaggcgacgcaggacaccctgcgccggggcgaacggatgacggagctgttgaagcaaccgcagtatcacccgctgacgttcgatcggcaggtcgcgtcgctctggacgggcgtgaacggctatctggacgacatcccggtcgaggccgtgcagaagttcgagcgcgagtggctcgccttcttggaccgcgagtatccgcaggtgttccaacagatgcaggagcgcaaatcgcttgaggacgataccatcgagctcatgaaagaagcgatggcgaagttcaagccgacgtttgtgccctga

SEQ ID NO: 1295 - protein, 500 aa, Bacillus sp. TA2.A1
MSIRPEEISALIKKQIENYEADLEVVEVGTVIQVGDGIARVHGLEKVMAGELLEFENGVMGMAQNLEEDNVGVVILGPYTEIREGTQVKRTGRIMEVPVGEALLGRVVNPLGQPLDGRGPIETAEYRPIESPAPGVMDRKSVHEPLQTGIKAIDSMIPIGRGQRELIIGDRQTGKTTIAIDTIINQKGQDVICIYVAIGQKQSTVAGVVETLRQHDALDYTIVVTASASEPAPLLYLAPYAGCAMGEYFMYKGKHALVVYDDLSKQAAAYRELSLLLRRPPGREAYPGDVFYLHSRLLERAAKLSDEKGGGSLTALPFIETQAGDVSAYIPTNVISITDGQIFLESDLFYSGVRPAVNVGISVSRVGGAAQIKAMKKVAGTLRLDLAQYRELQAFAQFGSDLDKATQAKLNRGERTVEILKQDEHKPMPVEEQVISIYAVTNGFMDDIPVEDVRRFEEELLSFMRANKDSLLDHIRQTGELPDTKELDAAIEEFKKGFTP

SEQ ID NO: 1296 - protein, 500 aa, Carboxydothermus hydrogenoformans Z-2901
MNLRPEEIGSIIKQQIENYQVQVEVSSVGTVIQVGDGIARVYGLEDCMASELLEFPGGVLGMALNLEEDNVGCVILGPYTHIKEGDTVKRTGRVVSVPVGEALIGRVVNPLGQPLDGKGPIVTDKFRPVERIAPGVITRKSVHEPLQTGIKAIDSMIPIGRGQRELIIGDRQTGKTAIAIDTIINQKNTDVICIYVAIGQKASTVAKVVQTLKDHGAMDYTIVVSATASDPAPLLYLAPYAGCAMGEEFMEQGKHVLVVYDDLSKQAAAYRELSLLLRRPPGREAYPGDVFYLHSRLLERAAKLSDEYGGGSLTALPIIETQAGDVSAYIPTNVISITDGQIYLESDLFYAGVRPAVNVGLSVSRVGGAAQIKAMKQVAGSLRLDLAQYRELAAFAQFGSDLDKATLARLTRGERLVELLKQDQYKPMPVEEQVMAIFAAVNGYLDDLPVEKVRPFEAEFLKFMRANYPQIGEEIRTKGVLTDELTSRLKSAIEEFKKTF

SEQ ID NO: 1297 - protein, 499 aa, Geobacillus thermodenitrificans NG80-2
MSIRAEEISALIKQQIENYESQIQVSDVGTVIQIGDGIARVHGLDNVMSGELVEFANGVMGMALNLEENNVGIVILGPYTGIKEGDEVRRTGRIMEVPVGEALIGRVVNPLGQPVDGLGPVETTETRPIESPAPGVMDRKSVHEPLQTGIKAIDALVPIGRGQRELIIGDRQTGKTAVAIDTILNQKGQDMICIYVAIGQKESTVRTVVETLRKHGALDYTIVVTASASQPAPLLFLAPYAGVSMGEYFMYKGKHVLVVYDDLSKQAAAYRELSLLLRRPPGREAYPGDVFYLHSRLLERAAKLSDAKGAGSLTALPFVETQAGDISAYIPTNVISITDGQIFLQSDLFFSGVRPAINAGLSVSRVGGAAQIKAMKKVSGTLRLDLAAYRELEAFAQFGSDLDKATQAKLARGARTVEVLKQDLHQPIPVEKQVAIIYALTRGFLDDIPVEDVRRFEKEFFLWLDQNGQHLLEHIRTTKDLPNEEDFNKAIEAFKKTFV

SEQ ID NO: 1298 - protein, 499 aa, Geobacillus kaustophilus HTA426
MSIRAEEISALIKQQIENYESQIQVSDVGTVIQVGDGIARAHGLDNVMSGELVEFANGVMGMALNLEENNVGIVILGPYTGIKEGDEVRRTGRIMEVPVGEALIGRVVNPLGQPVDGLGPVETTETRPIESPAPGVMDRRSVHEPLQTGIKAIDALVPIGRGQRELIIGDRQTGKTSVAIDTIINQKDQNMICIYVAIGQKESTVRTVVETLRKHGALDYTIVVTASASQPAPLLFLAPYAGVAMGEYFMYKGQHVLVVYDDLSKQAAAYRELSLLLRRPPGREAYPGDIFYLHSRLLERAAKLSDAKGGGSLTALPFVETQAGDISAYIPTNVISITDGQIFLQSDLFFSGVRPAINAGLSVSRVGGAAQIKAMKKVAGTLRLDLAAYRELEAFAQFGSDLDKATQAKLARGARTVEVLKQDLHQPIPVEKQVLIIYALTRGFLDDIPVEDVRRFEKEFYLWLDQNGQHLLEHIRTTKDLPNEDDLNKAIEAFKKTFV

SEQ ID NO: 1299 - protein, 498 aa, Nitratiruptor sp. SB155-2
LQADEISSIIKERIEDFELKIDVEETGKVISFGDGVAKVFGLNNVMAGEMLEFDNGDKGMALNLEETNVGVVVLGRGEGIREGSSVKRLGQLLKAPVGEALVGRVINAIGEPIDGKGPIEATEYRYVEEKAPGIMARKSVHEPLQTGIKAIDALVPIGRGQRELIIGDRQTGKTTVAIDTIINQKGQDVVCIYVAVGQKQSTVAQVVKKLEEHGAMDYTIVVNAGASEPAALQFLAPYTGVTIGEYFRDNGKHALIVYDDLSKHAVAYREMSLILRRPPGREAYPGDVFYLHSRLLERAAKLNDKLGAGSLTALPIIETQAGDVSAYIPTNVISITDGQIFLESDLFNAGIRPAINVGISVSRVGGAAQIKAMKQVAGTLRLDLAQYRELEAFAQFASDLDEASRKQLERGMRMVEILKQPPYSPLPVEKQVVIIYAGANGFLDDIEVSAIGKFEYELYSFIEAKYPQIFELIRERKALDDEIKELLNKAIEEFKASF

SEQ ID NO: 1300 - protein, 502 aa, Artificial
  Substituion in SEQ ID NO 1293
MSIRPDEISALIKQQIEQFEVKAEVRDTGTVLSVGDGIARLYGLDNVMAGELVEFESGVYGMALNLEEDNVGVVVLGSVNGIREGEQVRRTGRLVTVPVGPQLLGRVVNALGQPIDNKGPIEATEYRPVESPAPGVIVRRSVHEPLETGIKAIDSMVPIGRGQRELIIGDRQTGKTAIALDTIINQKGKDVKCIYVAIGQKQSTVAQVVETLRRYGAMEYTTVVVASASEPAPLLFLAPYAGCAMAEYYLYNGQHALVVYDDLSKQAAAYREMSLLLRRPPGREAYPGDVFYLHSRLLERAAKLNDEHGGGSLTALPFIETQAGDISAYIPTNVISITDGQIFLESDLFFAGVRPAINVGSSVSRVGSAAQTKAMKKVAGTLKLDLAQYRELQAFTQFGSDLDKATQDTLRRGERMTELLKQPQYHPLTFDRQVASLWTGVNGYLDDIPVEAVQKFEREWLAFLDREYPQVFQQMQERKSLEDDTIELMKEAMAKFKPTFVP

SEQ ID NO: 1301 - protein, 502 aa, Artificial
  Substituion in SEQ ID NO 1293
MSIRPDEISALIKQQIEQFEVKAEVRDTGTVLSVGDGIARLYGLDNVMAGELVEFESGVYGMALNLEEDNVGVVVLGSVQGIREGEQVRRTGRLVTVPVGPQLLGRVVNALGQPIDNKGPIEATEYRPVESPAPGVIVRRSVHEPLETGIKAIDSMVPIGRGQRELIIGDRQTGKTAIALDTIINQKGKDVKCIYVAIGQKQSTVAQVVETLRRYGAMEYTTVVVASASEPAPLLFLAPYAGCAMAEYYLYNGQHALVVYDDLSKQAAAYREMSLLLRRPPGREAYPGDVFYLHSRLLERAAKLNDEHGGGSLTALPFIETQAGDISAYIPTNVISITDGQIFLESDLFFAGVRPAINVGSSVSRVGSAAQTKAMKKVAGTLKLDLAQYRELQAFTQFGSDLDKATQDTLRRGERMTELLKQPQYHPLTFDRQVASLWTGVNGYLDDIPVEAVQKFEREWLAFLDREYPQVFQNMQERKSLEDDTIELMKEAMAKFKPTFVP

SEQ ID NO: 1302 - protein, 502 aa, Artificial
  Substituion in SEQ ID NO 1293
MSIRPDEISALIKQQIEQFEVKAEVRDTGTVLSVGDGIARLYGLDNVMAGELVEFESGVYGMALNLEEDNVGVVVLGSVQGIREGDQVRRTGRLVTVPVGPQLLGRVVNALGQPIDNKGPIEATEYRPVESPAPGVIVRRSVHEPLETGIKAIDSMVPIGRGQRELIIGDRQTGKTAIALDTIINQKGKDVKCIYVAIGQKQSTVAQVVETLRRYGAMEYTTVVVASASEPAPLLFLAPYAGCAMAEYYLYNGQHALVVYDDLSKQAAAYREMSLLLRRPPGREAYPGDVFYLHSRLLERAAKLNDEHGGGSLTALPFIETQAGDISAYIPTNVISITDGQIFLESDLFFAGVRPAINVGSSVSRVGSAAQTKAMKKVAGTLKLDLAQYRELQAFTQFGSDLDKATQDTLRRGERMTELLKQPQYHPLTFDRQVASLWTGVNGYLDDIPVEAVQKFEREWLAFLDREYPQVFQQMQERKSLEDDTIELMKEAMAKFKPTFVP

SEQ ID NO: 1303 - protein, 502 aa, Artificial
  Substituion in SEQ ID NO 1293
MSIRPDEISALIKQQIEQFEVKAEVRDTGTVLSVGDGIARLYGLDNVMAGELVEFESGVYGMALNLEEDNVGVVVLGSVQGIREGEQVRRTGRLVTVPVGPQLLGRVVNALGQPIDNKGPIEATEYRPVESPAPGVIVRRSVHEPLETGIKAIDSMVPIGRGQRELIIGDRQTGKTAIALDTIINQKGKDVKCIYVAIGQKQSTVAQVVETLRRYGAMEYTTVVVASASEPAPLLFLAPYAGCAMAEYYLYNGQHALVVYDDLSKQAAAYREMSLLLRRPPGREAYPGDVFYLHSRLLERAAKLNDEHGGGSLTALPFIETQAGDISAYIPTNVISITDGQIFLESDLFFAGVRPAINVGSSVSRVGSAAQTKAMKKVAGTLKLDLAQYRELQAFTQFGSDLDKATQDTLRRGERMTELLKQPQYHPLTFDRQVASLWTGVNGYLDDIPVEAVQKFEREWLAFLDREYPQVFQQMQERKSLEDETIELMKEAMAKFKPTFVP

SEQ ID NO: 1304 - protein, 502 aa, Artificial
  Substituion in SEQ ID NO 1293
MSIRPDEISALIKQQIEQFEVKAEVRDTGTVLSVGDGIARLYGLDNVMAGELVEFESGVYGMALNLEEDNVGVVVLGSVQGIREGEQVRRTGRLVTVPVGPQLLGRVVNALGQPIDNKGPIEATEYRPVESPAPGVIVRRSVHEPLETGIKAIDSMVPIGRGQRELIIGDRQTGKTAIALDTIINQKGKDVKCIYVAIGQKQSTVANVVETLRRYGAMEYTTVVVASASEPAPLLFLAPYAGCAMAEYYLYNGQHALVVYDDLSKQAAAYREMSLLLRRPPGREAYPGDVFYLHSRLLERAAKLNDEHGGGSLTALPFIETQAGDISAYIPTNVISITDGQIFLESDLFFAGVRPAINVGSSVSRVGSAAQTKAMKKVAGTLKLDLAQYRELQAFTQFGSDLDKATQDTLRRGERMTELLKQPQYHPLTFDRQVASLWTGVNGYLDDIPVEAVQKFEREWLAFLDREYPQVFQQMQERKSLEDDTIELMKEAMAKFKPTFVP

SEQ ID NO: 1305 - DNA, 1509 bp, Artificial
  Substituion in SEQ ID NO 1294
ttgagcattcgtccggatgaaatcagcgcgctcatcaagcaacagatcgagcagttcgaggtcaaggccgaggtgcgcgacacgggcacggtgctgtcggtgggcgacggcattgcgcgcctctatggcttggacaacgtcatggcgggcgaactggtcgagttcgaaagcggcgtgtacggcatggcgctgaacctggaggaggacaacgtcggcgtcgtggtgctcgggtccgtgaatggcatccgcgaaggcgaacaggtgcgccgcaccggacgcttggtcacggtgccggtgggtccgcagctcttggggcgcgtcgtgaacgcgctgggtcaacccattgacaataagggccccattgaggccacggagtatcgtcccgtcgagtcgccggcgccgggcgtcatcgtgcgccgctctgtgcacgagccgctcgagacgggcatcaaggccatcgactcgatggtgcccatcggacgcggtcagcgcgagctgatcatcggcgaccgccagacggggaaaacggccattgcgctcgacaccatcatcaaccaaaagggcaaggacgtgaagtgcatctacgtcgccatcgggcagaagcagtccacggtggcgcaagtcgtggagacgcttcgccgctacggcgcgatggagtacaccaccgtggtcgtggcgagcgcttcggagcccgctccgctcctgttcctcgctccctacgccgggtgcgcgatggcggagtactacctgtacaacgggcagcacgcgctcgtggtgtacgacgacctgtcgaagcaggccgcggcataccgcgagatgtcgctcttgctgcgccgcccgccgggccgcgaggcgtatccgggagacgtgttctatctgcattcgcgcctcttggagcgcgccgcgaagctgaacgacgagcacggcggcggttcgctcacggccctgccgttcattgagacgcaggcgggcgacatctccgcgtacatcccgaccaacgtcatctcgatcacggacggccagatcttcctcgagtcggatctgttcttcgcgggcgtgcggccggccatcaacgtcggatcgtcggtgtcccgcgtgggctccgccgcgcagacgaaggccatgaagaaggtcgcgggcacgctgaagctcgatctcgcccagtaccgcgagctccaggccttcacccagttcggcagcgatctggacaaggcgacgcaggacaccctgcgccggggcgaacggatgacggagctgttgaagcaaccgcagtatcacccgctgacgttcgatcggcaggtcgcgtcgctctggacgggcgtgaacggctatctggacgacatcccggtcgaggccgtgcagaagttcgagcgcgagtggctcgccttcttggaccgcgagtatccgcaggtgttccaacagatgcaggagcgcaaatcgcttgaggacgataccatcgagctcatgaaagaagcgatggcgaagttcaagccgacgtttgtgccctga

SEQ ID NO: 1306 - DNA, 1509 bp, Artificial
  Substituion in SEQ ID NO 1294
ttgagcattcgtccggatgaaatcagcgcgctcatcaagcaacagatcgagcagttcgaggtcaaggccgaggtgcgcgacacgggcacggtgctgtcggtgggcgacggcattgcgcgcctctatggcttggacaacgtcatggcgggcgaactggtcgagttcgaaagcggcgtgtacggcatggcgctgaacctggaggaggacaacgtcggcgtcgtggtgctcgggtccgtgcagggcatccgcgaaggcgaacaggtgcgccgcaccggacgcttggtcacggtgccggtgggtccgcagctcttggggcgcgtcgtgaacgcgctgggtcaacccattgacaataagggccccattgaggccacggagtatcgtcccgtcgagtcgccggcgccgggcgtcatcgtgcgccgctctgtgcacgagccgctcgagacgggcatcaaggccatcgactcgatggtgcccatcggacgcggtcagcgcgagctgatcatcggcgaccgccagacggggaaaacggccattgcgctcgacaccatcatcaaccaaaagggcaaggacgtgaagtgcatctacgtcgccatcgggcagaagcagtccacggtggcgcaagtcgtggagacgcttcgccgctacggcgcgatggagtacaccaccgtggtcgtggcgagcgcttcggagcccgctccgctcctgttcctcgctccctacgccgggtgcgcgatggcggagtactacctgtacaacgggcagcacgcgctcgtggtgtacgacgacctgtcgaagcaggccgcggcataccgcgagatgtcgctcttgctgcgccgcccgccgggccgcgaggcgtatccgggagacgtgttctatctgcattcgcgcctcttggagcgcgccgcgaagctgaacgacgagcacggcggcggttcgctcacggccctgccgttcattgagacgcaggcgggcgacatctccgcgtacatcccgaccaacgtcatctcgatcacggacggccagatcttcctcgagtcggatctgttcttcgcgggcgtgcggccggccatcaacgtcggatcgtcggtgtcccgcgtgggctccgccgcgcagacgaaggccatgaagaaggtcgcgggcacgctgaagctcgatctcgcccagtaccgcgagctccaggccttcacccagttcggcagcgatctggacaaggcgacgcaggacaccctgcgccggggcgaacggatgacggagctgttgaagcaaccgcagtatcacccgctgacgttcgatcggcaggtcgcgtcgctctggacgggcgtgaacggctatctggacgacatcccggtcgaggccgtgcagaagttcgagcgcgagtggctcgccttcttggaccgcgagtatccgcaggtgttccaaaatatgcaggagcgcaaatcgcttgaggacgataccatcgagctcatgaaagaagcgatggcgaagttcaagccgacgtttgtgccctga

SEQ ID NO: 1307 - DNA, 1509 bp, Artificial
  Substituion in SEQ ID NO 1294
ttgagcattcgtccggatgaaatcagcgcgctcatcaagcaacagatcgagcagttcgaggtcaaggccgaggtgcgcgacacgggcacggtgctgtcggtgggcgacggcattgcgcgcctctatggcttggacaacgtcatggcgggcgaactggtcgagttcgaaagcggcgtgtacggcatggcgctgaacctggaggaggacaacgtcggcgtcgtggtgctcgggtccgtgcagggcatccgcgaaggcgatcaggtgcgccgcaccggacgcttggtcacggtgccggtgggtccgcagctcttggggcgcgtcgtgaacgcgctgggtcaacccattgacaataagggccccattgaggccacggagtatcgtcccgtcgagtcgccggcgccgggcgtcatcgtgcgccgctctgtgcacgagccgctcgagacgggcatcaaggccatcgactcgatggtgcccatcggacgcggtcagcgcgagctgatcatcggcgaccgccagacggggaaaacggccattgcgctcgacaccatcatcaaccaaaagggcaaggacgtgaagtgcatctacgtcgccatcgggcagaagcagtccacggtggcgcaagtcgtggagacgcttcgccgctacggcgcgatggagtacaccaccgtggtcgtggcgagcgcttcggagcccgctccgctcctgttcctcgctccctacgccgggtgcgcgatggcggagtactacctgtacaacgggcagcacgcgctcgtggtgtacgacgacctgtcgaagcaggccgcggcataccgcgagatgtcgctcttgctgcgccgcccgccgggccgcgaggcgtatccgggagacgtgttctatctgcattcgcgcctcttggagcgcgccgcgaagctgaacgacgagcacggcggcggttcgctcacggccctgccgttcattgagacgcaggcgggcgacatctccgcgtacatcccgaccaacgtcatctcgatcacggacggccagatcttcctcgagtcggatctgttcttcgcgggcgtgcggccggccatcaacgtcggatcgtcggtgtcccgcgtgggctccgccgcgcagacgaaggccatgaagaaggtcgcgggcacgctgaagctcgatctcgcccagtaccgcgagctccaggccttcacccagttcggcagcgatctggacaaggcgacgcaggacaccctgcgccggggcgaacggatgacggagctgttgaagcaaccgcagtatcacccgctgacgttcgatcggcaggtcgcgtcgctctggacgggcgtgaacggctatctggacgacatcccggtcgaggccgtgcagaagttcgagcgcgagtggctcgccttcttggaccgcgagtatccgcaggtgttccaacagatgcaggagcgcaaatcgcttgaggacgataccatcgagctcatgaaagaagcgatggcgaagttcaagccgacgtttgtgccctga

SEQ ID NO: 1308 - DNA, 1509 bp, Artificial
  Substituion in SEQ ID NO 1294
ttgagcattcgtccggatgaaatcagcgcgctcatcaagcaacagatcgagcagttcgaggtcaaggccgaggtgcgcgacacgggcacggtgctgtcggtgggcgacggcattgcgcgcctctatggcttggacaacgtcatggcgggcgaactggtcgagttcgaaagcggcgtgtacggcatggcgctgaacctggaggaggacaacgtcggcgtcgtggtgctcgggtccgtgcagggcatccgcgaaggcgaacaggtgcgccgcaccggacgcttggtcacggtgccggtgggtccgcagctcttggggcgcgtcgtgaacgcgctgggtcaacccattgacaataagggccccattgaggccacggagtatcgtcccgtcgagtcgccggcgccgggcgtcatcgtgcgccgctctgtgcacgagccgctcgagacgggcatcaaggccatcgactcgatggtgcccatcggacgcggtcagcgcgagctgatcatcggcgaccgccagacggggaaaacggccattgcgctcgacaccatcatcaaccaaaagggcaaggacgtgaagtgcatctacgtcgccatcgggcagaagcagtccacggtggcgcaagtcgtggagacgcttcgccgctacggcgcgatggagtacaccaccgtggtcgtggcgagcgcttcggagcccgctccgctcctgttcctcgctccctacgccgggtgcgcgatggcggagtactacctgtacaacgggcagcacgcgctcgtggtgtacgacgacctgtcgaagcaggccgcggcataccgcgagatgtcgctcttgctgcgccgcccgccgggccgcgaggcgtatccgggagacgtgttctatctgcattcgcgcctcttggagcgcgccgcgaagctgaacgacgagcacggcggcggttcgctcacggccctgccgttcattgagacgcaggcgggcgacatctccgcgtacatcccgaccaacgtcatctcgatcacggacggccagatcttcctcgagtcggatctgttcttcgcgggcgtgcggccggccatcaacgtcggatcgtcggtgtcccgcgtgggctccgccgcgcagacgaaggccatgaagaaggtcgcgggcacgctgaagctcgatctcgcccagtaccgcgagctccaggccttcacccagttcggcagcgatctggacaaggcgacgcaggacaccctgcgccggggcgaacggatgacggagctgttgaagcaaccgcagtatcacccgctgacgttcgatcggcaggtcgcgtcgctctggacgggcgtgaacggctatctggacgacatcccggtcgaggccgtgcagaagttcgagcgcgagtggctcgccttcttggaccgcgagtatccgcaggtgttccaacagatgcaggagcgcaaatcgcttgaggacgaaaccatcgagctcatgaaagaagcgatggcgaagttcaagccgacgtttgtgccctga

SEQ ID NO: 1309 - DNA, 1509 bp, Artificial
  Substituion in SEQ ID NO 1294
ttgagcattcgtccggatgaaatcagcgcgctcatcaagcaacagatcgagcagttcgaggtcaaggccgaggtgcgcgacacgggcacggtgctgtcggtgggcgacggcattgcgcgcctctatggcttggacaacgtcatggcgggcgaactggtcgagttcgaaagcggcgtgtacggcatggcgctgaacctggaggaggacaacgtcggcgtcgtggtgctcgggtccgtgcagggcatccgcgaaggcgaacaggtgcgccgcaccggacgcttggtcacggtgccggtgggtccgcagctcttggggcgcgtcgtgaacgcgctgggtcaacccattgacaataagggccccattgaggccacggagtatcgtcccgtcgagtcgccggcgccgggcgtcatcgtgcgccgctctgtgcacgagccgctcgagacgggcatcaaggccatcgactcgatggtgcccatcggacgcggtcagcgcgagctgatcatcggcgaccgccagacggggaaaacggccattgcgctcgacaccatcatcaaccaaaagggcaaggacgtgaagtgcatctacgtcgccatcgggcagaagcagtccacggtggcgaatgtcgtggagacgcttcgccgctacggcgcgatggagtacaccaccgtggtcgtggcgagcgcttcggagcccgctccgctcctgttcctcgctccctacgccgggtgcgcgatggcggagtactacctgtacaacgggcagcacgcgctcgtggtgtacgacgacctgtcgaagcaggccgcggcataccgcgagatgtcgctcttgctgcgccgcccgccgggccgcgaggcgtatccgggagacgtgttctatctgcattcgcgcctcttggagcgcgccgcgaagctgaacgacgagcacggcggcggttcgctcacggccctgccgttcattgagacgcaggcgggcgacatctccgcgtacatcccgaccaacgtcatctcgatcacggacggccagatcttcctcgagtcggatctgttcttcgcgggcgtgcggccggccatcaacgtcggatcgtcggtgtcccgcgtgggctccgccgcgcagacgaaggccatgaagaaggtcgcgggcacgctgaagctcgatctcgcccagtaccgcgagctccaggccttcacccagttcggcagcgatctggacaaggcgacgcaggacaccctgcgccggggcgaacggatgacggagctgttgaagcaaccgcagtatcacccgctgacgttcgatcggcaggtcgcgtcgctctggacgggcgtgaacggctatctggacgacatcccggtcgaggccgtgcagaagttcgagcgcgagtggctcgccttcttggaccgcgagtatccgcaggtgttccaacagatgcaggagcgcaaatcgcttgaggacgataccatcgagctcatgaaagaagcgatggcgaagttcaagccgacgtttgtgccctga

SEQ ID NO: 1310 - protein, 365 aa, Alicyclobacillus acidocaldarius
MTDMGKPTIIVMEGDQTGQELLEEALRVLSPDVTGYEIEIRKFDLSLENRRRTQNAVVHEAAEAMRDTGLGLKAATITPEEKGDVGSPNAILRKEINGTVIVRTGRRIPGIAPPVGVYSPISVIRMAVDDAYGAKEWREQLENGDEVAYRTEKISRSVCRGVAKYAFQHARRMHAKVFGGPKYTVSPVYEGMLKEEMDAAAKEYPDVRYEPQLIDATYALLLARAGEALVIPALNRDGDCLSDLVLQMFGTIAGSESLLLSLDESFQPKVVMAEAPHGTAPNLFRKNMANPMAMILAGAALLNYIQDKDAHTVSRAIYEATLESIVDGIRTADLGGHATTTEFTDEVIRRVRTKLEVWSTFGDAV

SEQ ID NO: 1311 - DNA, 1098 bp, Alicyclobacillus acidocaldarius
gtgacggacatggggaaaccgaccatcatcgtgatggagggtgatcagacgggacaggagcttctggaggaagcgctccgcgtgctgtcgcccgatgtcacggggtacgagattgagattcgcaagtttgatctgagcctcgaaaatcgccggcgcacgcaaaatgccgtggtgcacgaggccgcagaagccatgcgggacacgggcctcgggctcaaggccgcgaccatcacgccggaagaaaagggcgacgtgggtagcccgaacgccatcctgcgcaaggaaatcaacggcacggtgattgtccgcactggacgccgtatcccggggatcgcgccgccggtgggcgtctactcgcccatttcggtcatccgcatggcggtggacgacgcctacggagccaaggaatggcgcgaacaactggaaaacggcgacgaggtggcgtaccgcacggagaaaatttcgcgatccgtctgccggggcgtggccaagtacgcgttccagcacgcgcgccgcatgcacgcgaaggtgtttggcgggcccaaatacaccgtgagccctgtgtacgaaggcatgctgaaggaagaaatggacgccgcggccaaggaatatcccgacgtgcgctacgagccgcagctcatcgacgcgacgtatgcgctcctcctggcgcgcgcgggtgaagcactcgtcatcccggcgctgaaccgcgacggcgactgcttgtccgatctcgtcctccagatgttcggcaccatcgccggatcagaatcactgcttctgtcgctcgacgagtcgttccagcccaaggtcgtgatggccgaagcgcctcatgggacggcgcccaatctcttcaggaaaaacatggccaacccgatggccatgatcctggccggcgccgccctgttgaactacatccaagacaaggacgcccacacggtatcgcgggccatctacgaggccacgctcgagtccattgtcgatgggattcgcacggccgatctcggcggccacgcgacgaccaccgagttcacggacgaagtcattcggagggttcggacgaaactcgaggtctggagcacgttcggcgacgccgtttga

SEQ ID NO: 1312 - protein, 359 aa, Herpetosiphon aurantiacus ATCC 23779
MSKPTIVVLEGDQTGQELLEESLRVLDPAVTGVDIELKRYDLSLESRRATNNQIVLEAAQAMKEAGFGLKAATITPEKAGDVGSPNAILREQINGTVIVRTGRRIPGVRPVGGAYAPISVIRMAVDDAYGAKEWREGEGDNEVAYRTEKITRGTCRAVSEYAFMHARRMKAKVFGGPKYTVSPIYEGMLKEEMDAAAKRYADVRYEPQLIDATYALLLTNSGDPMVIPALNRDGDCLSDLVLQMFGTIAGAESLLLAFDKDFKVNVVMAEAPHGTAPSLEGKNVANPMAMILASAALLDYIDTPQANMAARAISEATLEAVYDGVRTADLGGHTTTSDFTDEVIRRVKTKMEVWPSLGN

SEQ ID NO: 1313 - protein, 355 aa, Rubrobacter xylanophilus DSM 9941
MESRTIAVLEGDQTGQELLEEALRVLDPGVTGLELEFRRFDLSLENRRRTENRVVHEAAAAMRECGYGIKAATITPERAGDVGSPNALLRKDINGTVIVRTGRRIPGVNPLPGVHAPISVVRMAVDDAYGAEEWREGEGPDEVAYRTEKISRRVCRGVAEFAFIHARRMRAKVFGGPKWTVSPVYEGMLKEEMDRAAEKNPDVRYEPQLIDATYALLLSTYGEPLVIPTLNRDGDCLSDMVLQMFGSIAGAESLLIALDEEERPQTVMAEAPHGTAPSLEGKNIANPMAMILAGAALLGFFEDEQAGRVSRAIYESTFETVLDGVKTADLGGSATTTEFTDEVIRHVRNKLEVWS

SEQ ID NO: 1314 - protein, 355 aa, Pelobacter carbinolicus DSM 2380
PTITVLEGDQTGQELLEEALRILDPAVTGVTVTFKHFDLSLDNRRATKNKVVYEAAESMKSTGLGLKAATITPAIKGDVGSPNAILRDQVDGTVIVRTGRRIPGIRPSGGAYAPISVVRMAVGGSYGAQESRQGTGLDEVASRTESITRRNCHAVAEFAFRHAQKLGVKVFGGPKFTVSPVYEGMLKEEMDAAAERFPDVVYEPQLIDATYALLLTNGGDGMVIPSLNRDGDCLSDFVLQMFGSIAGAESLLLSFDESWTPAVVMAEAPHGTAPSLQGKNIANPMAMILAGGALLRYINHPDARRAARAISESVFEAVQQGFSTPDLGGSCTTTEFTDEVIRRVASKLEVWQTLG

SEQ ID NO: 1315 - protein, 357 aa, Microcystis aeruginosa PCC 7806
PTIVVMHGDQTGEELLLEALRVLQPSIIRQPLNFADVDLSLAQRRQSNNQVVHEAAEATLKTGLALKAATITPEIKGDVGSPNAILREAMNSQVILRIGRRIPGIRPIGGVYSPIAIVRMAVDDAYGAKEWRETTATGDEIAYRTSRISRATSRAVAEFTFQHAKKTGARVFGGPKFTVSATYEGMFKEELDAAAQRHPEVRYQPLLIDATFALLLQTDGEALVIPALNRDGDLLSDFVLQLYGSIAGAESLVLGFDEETLAVKTIMAEAPHGTAPALEGKNIANPMAMILASAALLGYIETSEARKASRAIYESVFETIHEGKKTPDLGGQMTMSEFTDEVIRRVVSKLEVWSALG

SEQ ID NO: 1316 - protein, 357 aa, Microcystis aeruginosa NIES-843
PTIVVMHGDQTGEELLLEALRVLQPSIIRQPLNFADFDLSLAQRRQSNNQVVHEAAEATLKTGLALKAATITPEIKGDVGSPNAILREAMNSQVILRIGRRIPGIRPIGGVYSPIAIVRMAVDDAYGAKEWRETTATGDEIAYRTSRISRATSRAVAEFTFQQAKKTGARVFGGPKFTVSATYEGMFKEELDAAAQRHPEVRYQPLLIDATFALLLQTDGEALVIPALNRDGDLLSDFVLQLYGSIAGAESLVLGFDEETLAVKTIMAEAPHGTAPALEGKNIANPMAMILAAAALLGYIETNEARKASRAIYESVFETIHEGKKTPDLGGQMTMSEFTDEVIRRVVSKLEVWSALG

SEQ ID NO: 1317 - protein, 365 aa, Artificial
  Substituion in SEQ ID NO 1310
MTDMGKPTILVMEGDQTGQELLEEALRVLSPDVTGYEIEIRKFDLSLENRRRTQNAVVHEAAEAMRDTGLGLKAATITPEEKGDVGSPNAILRKEINGTVIVRTGRRIPGIAPPVGVYSPISVIRMAVDDAYGAKEWREQLENGDEVAYRTEKISRSVCRGVAKYAFQHARRMHAKVFGGPKYTVSPVYEGMLKEEMDAAAKEYPDVRYEPQLIDATYALLLARAGEALVIPALNRDGDCLSDLVLQMFGTIAGSESLLLSLDESFQPKVVMAEAPHGTAPNLFRKNMANPMAMILAGAALLNYIQDKDAHTVSRAIYEATLESIVDGIRTADLGGHATTTEFTDEVIRRVRTKLEVWSTFGDAV

SEQ ID NO: 1318 - protein, 365 aa, Artificial
  Substituion in SEQ ID NO 1310
MTDMGKPTIIVMEGDQTGQELLEEALRVLSPDVTGYEIEIRKFDLSLENRRRTQNAVVHEAAEAMRDTGLGLKAATITPEEKGDVGSPNAILRKEINGTVIVRTGRRIPGIAPPVGVYSPISVIRMAVDDAYGAKEWREQLENGDEVAYRTEKISRSVCRGVAKYAFQHARRMHAKVFGGPKYTVSPVYEGMLKEEMDAAAKEYPDVRYEPQLIDATYALLLARAGEALVIPALNRDGDCLSDLVLQMFGTIAGSESLLLSLDESFQPKVVMAEAPHGTAPNLFKKNMANPMAMILAGAALLNYIQDKDAHTVSRAIYEATLESIVDGIRTADLGGHATTTEFTDEVIRRVRTKLEVWSTFGDAV

SEQ ID NO: 1319 - protein, 365 aa, Artificial
  Substituion in SEQ ID NO 1310
MTDMGKPTIIVMEGDQTGQELLEEALRVLSPDVTGYEIEIRKFDLSLENRRRTQNAVVHEAAEAMRDTGLGLKAATITPEEKGDVGSPNAILRKEINGTVIVRTGRRIPGIAPPVGVYSPISVIRMAVDDAYGAKEWREQLENGDEVAYRTEKISRSVCRGVAKYAFQHARRMHAKVFGGPKYTVSPVYEGMLKEEMDAAAKEYPDVRYEPQLIDATYALLLARAGEALVIPALNRDGDCLSDLVLQMFGTIAGSESLLLSLDESFQPKVVMAEAPHGTAPNLFRKNMANPMAMILAGAALLQYIQDKDAHTVSRAIYEATLESIVDGIRTADLGGHATTTEFTDEVIRRVRTKLEVWSTFGDAV

SEQ ID NO: 1320 - protein, 365 aa, Artificial
  Substituion in SEQ ID NO 1310
MTDMGKPTIIVMEGDQTGQELLEEALRVLSPDVTGYEIEIRKFDLSLENRRRTQNAVVHEAAEAMRDTGLGLKAATITPEEKGDVGSPNAILRKEINGTVIVRTGRRIPGIAPPVGVYSPISVIRMAVDDAYGAKEWREQLENGDEVAYRTEKISRSVCRGVAKYAFQHARRMHAKVFGGPKYTVSPVYEGMLKEEMDAAAKEYPDVKYEPQLIDATYALLLARAGEALVIPALNRDGDCLSDLVLQMFGTIAGSESLLLSLDESFQPKVVMAEAPHGTAPNLFRKNMANPMAMILAGAALLNYIQDKDAHTVSRAIYEATLESIVDGIRTADLGGHATTTEFTDEVIRRVRTKLEVWSTFGDAV

SEQ ID NO: 1321 - protein, 365 aa, Artificial
  Substituion in SEQ ID NO 1310
MTDMGKPTIIVMEGDQTGQELLEEALRVLSPDVTGYEIEIRKFDLSLENRRRTQNAVVHEAAEAMRDTGLGLKAATITPEEKGDVGSPNAILRKEINGTVIVRTGRRIPGIAPPVGVYSPISVIRMAVDDAYGAKEWREQLEQGDEVAYRTEKISRSVCRGVAKYAFQHARRMHAKVFGGPKYTVSPVYEGMLKEEMDAAAKEYPDVRYEPQLIDATYALLLARAGEALVIPALNRDGDCLSDLVLQMFGTIAGSESLLLSLDESFQPKVVMAEAPHGTAPNLFRKNMANPMAMILAGAALLNYIQDKDAHTVSRAIYEATLESIVDGIRTADLGGHATTTEFTDEVIRRVRTKLEVWSTFGDAV

SEQ ID NO: 1322 - DNA, 1098 bp, Artificial
  Substituion in SEQ ID NO 1311
gtgacggacatggggaaaccgaccatcttagtgatggagggtgatcagacgggacaggagcttctggaggaagcgctccgcgtgctgtcgcccgatgtcacggggtacgagattgagattcgcaagtttgatctgagcctcgaaaatcgccggcgcacgcaaaatgccgtggtgcacgaggccgcagaagccatgcgggacacgggcctcgggctcaaggccgcgaccatcacgccggaagaaaagggcgacgtgggtagcccgaacgccatcctgcgcaaggaaatcaacggcacggtgattgtccgcactggacgccgtatcccggggatcgcgccgccggtgggcgtctactcgcccatttcggtcatccgcatggcggtggacgacgcctacggagccaaggaatggcgcgaacaactggaaaacggcgacgaggtggcgtaccgcacggagaaaatttcgcgatccgtctgccggggcgtggccaagtacgcgttccagcacgcgcgccgcatgcacgcgaaggtgtttggcgggcccaaatacaccgtgagccctgtgtacgaaggcatgctgaaggaagaaatggacgccgcggccaaggaatatcccgacgtgcgctacgagccgcagctcatcgacgcgacgtatgcgctcctcctggcgcgcgcgggtgaagcactcgtcatcccggcgctgaaccgcgacggcgactgcttgtccgatctcgtcctccagatgttcggcaccatcgccggatcagaatcactgcttctgtcgctcgacgagtcgttccagcccaaggtcgtgatggccgaagcgcctcatgggacggcgcccaatctcttcaggaaaaacatggccaacccgatggccatgatcctggccggcgccgccctgttgaactacatccaagacaaggacgcccacacggtatcgcgggccatctacgaggccacgctcgagtccattgtcgatgggattcgcacggccgatctcggcggccacgcgacgaccaccgagttcacggacgaagtcattcggagggttcggacgaaactcgaggtctggagcacgttcggcgacgccgtttga

SEQ ID NO: 1323 - DNA, 1098 bp, Artificial
  Substituion in SEQ ID NO 1311
gtgacggacatggggaaaccgaccatcatcgtgatggagggtgatcagacgggacaggagcttctggaggaagcgctccgcgtgctgtcgcccgatgtcacggggtacgagattgagattcgcaagtttgatctgagcctcgaaaatcgccggcgcacgcaaaatgccgtggtgcacgaggccgcagaagccatgcgggacacgggcctcgggctcaaggccgcgaccatcacgccggaagaaaagggcgacgtgggtagcccgaacgccatcctgcgcaaggaaatcaacggcacggtgattgtccgcactggacgccgtatcccggggatcgcgccgccggtgggcgtctactcgcccatttcggtcatccgcatggcggtggacgacgcctacggagccaaggaatggcgcgaacaactggaaaacggcgacgaggtggcgtaccgcacggagaaaatttcgcgatccgtctgccggggcgtggccaagtacgcgttccagcacgcgcgccgcatgcacgcgaaggtgtttggcgggcccaaatacaccgtgagccctgtgtacgaaggcatgctgaaggaagaaatggacgccgcggccaaggaatatcccgacgtgcgctacgagccgcagctcatcgacgcgacgtatgcgctcctcctggcgcgcgcgggtgaagcactcgtcatcccggcgctgaaccgcgacggcgactgcttgtccgatctcgtcctccagatgttcggcaccatcgccggatcagaatcactgcttctgtcgctcgacgagtcgttccagcccaaggtcgtgatggccgaagcgcctcatgggacggcgcccaatctcttcaaaaaaaacatggccaacccgatggccatgatcctggccggcgccgccctgttgaactacatccaagacaaggacgcccacacggtatcgcgggccatctacgaggccacgctcgagtccattgtcgatgggattcgcacggccgatctcggcggccacgcgacgaccaccgagttcacggacgaagtcattcggagggttcggacgaaactcgaggtctggagcacgttcggcgacgccgtttga

SEQ ID NO: 1324 - DNA, 1098 bp, Artificial
  Substituion in SEQ ID NO 1311
gtgacggacatggggaaaccgaccatcatcgtgatggagggtgatcagacgggacaggagcttctggaggaagcgctccgcgtgctgtcgcccgatgtcacggggtacgagattgagattcgcaagtttgatctgagcctcgaaaatcgccggcgcacgcaaaatgccgtggtgcacgaggccgcagaagccatgcgggacacgggcctcgggctcaaggccgcgaccatcacgccggaagaaaagggcgacgtgggtagcccgaacgccatcctgcgcaaggaaatcaacggcacggtgattgtccgcactggacgccgtatcccggggatcgcgccgccggtgggcgtctactcgcccatttcggtcatccgcatggcggtggacgacgcctacggagccaaggaatggcgcgaacaactggaaaacggcgacgaggtggcgtaccgcacggagaaaatttcgcgatccgtctgccggggcgtggccaagtacgcgttccagcacgcgcgccgcatgcacgcgaaggtgtttggcgggcccaaatacaccgtgagccctgtgtacgaaggcatgctgaaggaagaaatggacgccgcggccaaggaatatcccgacgtgcgctacgagccgcagctcatcgacgcgacgtatgcgctcctcctggcgcgcgcgggtgaagcactcgtcatcccggcgctgaaccgcgacggcgactgcttgtccgatctcgtcctccagatgttcggcaccatcgccggatcagaatcactgcttctgtcgctcgacgagtcgttccagcccaaggtcgtgatggccgaagcgcctcatgggacggcgcccaatctcttcaggaaaaacatggccaacccgatggccatgatcctggccggcgccgccctgttgcaatacatccaagacaaggacgcccacacggtatcgcgggccatctacgaggccacgctcgagtccattgtcgatgggattcgcacggccgatctcggcggccacgcgacgaccaccgagttcacggacgaagtcattcggagggttcggacgaaactcgaggtctggagcacgttcggcgacgccgtttga

SEQ ID NO: 1325 - DNA, 1098 bp, Artificial
  Substituion in SEQ ID NO 1311
gtgacggacatggggaaaccgaccatcatcgtgatggagggtgatcagacgggacaggagcttctggaggaagcgctccgcgtgctgtcgcccgatgtcacggggtacgagattgagattcgcaagtttgatctgagcctcgaaaatcgccggcgcacgcaaaatgccgtggtgcacgaggccgcagaagccatgcgggacacgggcctcgggctcaaggccgcgaccatcacgccggaagaaaagggcgacgtgggtagcccgaacgccatcctgcgcaaggaaatcaacggcacggtgattgtccgcactggacgccgtatcccggggatcgcgccgccggtgggcgtctactcgcccatttcggtcatccgcatggcggtggacgacgcctacggagccaaggaatggcgcgaacaactggaaaacggcgacgaggtggcgtaccgcacggagaaaatttcgcgatccgtctgccggggcgtggccaagtacgcgttccagcacgcgcgccgcatgcacgcgaaggtgtttggcgggcccaaatacaccgtgagccctgtgtacgaaggcatgctgaaggaagaaatggacgccgcggccaaggaatatcccgacgtgaaatacgagccgcagctcatcgacgcgacgtatgcgctcctcctggcgcgcgcgggtgaagcactcgtcatcccggcgctgaaccgcgacggcgactgcttgtccgatctcgtcctccagatgttcggcaccatcgccggatcagaatcactgcttctgtcgctcgacgagtcgttccagcccaaggtcgtgatggccgaagcgcctcatgggacggcgcccaatctcttcaggaaaaacatggccaacccgatggccatgatcctggccggcgccgccctgttgaactacatccaagacaaggacgcccacacggtatcgcgggccatctacgaggccacgctcgagtccattgtcgatgggattcgcacggccgatctcggcggccacgcgacgaccaccgagttcacggacgaagtcattcggagggttcggacgaaactcgaggtctggagcacgttcggcgacgccgtttga

SEQ ID NO: 1326 - DNA, 1098 bp, Artificial
  Substituion in SEQ ID NO 1311
gtgacggacatggggaaaccgaccatcatcgtgatggagggtgatcagacgggacaggagcttctggaggaagcgctccgcgtgctgtcgcccgatgtcacggggtacgagattgagattcgcaagtttgatctgagcctcgaaaatcgccggcgcacgcaaaatgccgtggtgcacgaggccgcagaagccatgcgggacacgggcctcgggctcaaggccgcgaccatcacgccggaagaaaagggcgacgtgggtagcccgaacgccatcctgcgcaaggaaatcaacggcacggtgattgtccgcactggacgccgtatcccggggatcgcgccgccggtgggcgtctactcgcccatttcggtcatccgcatggcggtggacgacgcctacggagccaaggaatggcgcgaacaactggaacaaggcgacgaggtggcgtaccgcacggagaaaatttcgcgatccgtctgccggggcgtggccaagtacgcgttccagcacgcgcgccgcatgcacgcgaaggtgtttggcgggcccaaatacaccgtgagccctgtgtacgaaggcatgctgaaggaagaaatggacgccgcggccaaggaatatcccgacgtgcgctacgagccgcagctcatcgacgcgacgtatgcgctcctcctggcgcgcgcgggtgaagcactcgtcatcccggcgctgaaccgcgacggcgactgcttgtccgatctcgtcctccagatgttcggcaccatcgccggatcagaatcactgcttctgtcgctcgacgagtcgttccagcccaaggtcgtgatggccgaagcgcctcatgggacggcgcccaatctcttcaggaaaaacatggccaacccgatggccatgatcctggccggcgccgccctgttgaactacatccaagacaaggacgcccacacggtatcgcgggccatctacgaggccacgctcgagtccattgtcgatgggattcgcacggccgatctcggcggccacgcgacgaccaccgagttcacggacgaagtcattcggagggttcggacgaaactcgaggtctggagcacgttcggcgacgccgtttga

SEQ ID NO: 1327 - protein, 580 aa, Alicyclobacillus acidocaldarius
MPCHREMKGAIEHEEVVLMDDLWTVDGDDLRKLPYGAMYAKFRWPTPDRLNIAEWACRRHARVCPDAPAIWYDVDGGSAEMWTFGHLWRTTSRLAWALLRGLGVPTGGRVAILLPQSPQLAAAHLASYAIGAIAVPLFTLFGTDALRYRLQDSGATVVVTDSEQANRIMDIRADLPDLEHVIVTDARVPGTQFWDDVLALASSAEYHPMDASPDDPAVLIYTSGTTGSAKGALHGHRILLGHLPGVSLPHDFAPQPGDVFWTPADWAWIGGLYDVLLPALCWGVPVVAHRIRKFDPERAFALMERWRVRNAFMPPTSLKMMRHITDPRSRWHLHLRTLATGGEPLGAELLSWAREALGLSIHEFYGQTECNLVVANCSACFQPKPGSMGRPVPGHDVAVIDENGHVVSPGVIGEIAVRRPHPVMFIGYWNRPEETAAKFVGDWLKTGDLGRMDEEGYLWFVGRADDVITSAGYRIGPVEIEEAALQHSAVVMAAAVGTPDPVRGEVVKLFVKLREGVPANECLTAELQNWVKERVGAHSYPREIEFVDELPLTPSGKVRRRALREREYAQKGVPLPGKRG

SEQ ID NO: 1328 - DNA, 1743 bp, Alicyclobacillus acidocaldarius
gtgccgtgccacagggaaatgaaaggcgcgatcgagcatgaggaggtcgttctcatggacgacctttggacggtggatggggacgatctgcggaagttgccctacggggcgatgtatgccaagtttcggtggcccacgccggatcggctgaatatcgccgagtgggcgtgtcgcaggcatgcgcgggtgtgcccggatgcgcccgctatttggtatgacgtcgacggtgggtcggcggaaatgtggaccttcggccatctgtggcgcaccacaagcaggttggcctgggctcttctgagaggccttggggttccaaccgggggacgggtggccatccttctcccgcagtctccccagctcgcggcggcccacctcgcctcgtacgctatcggggcgatcgcggtacccctgttcacgctgttcggaacggacgcgcttcgctaccggctccaggatagcggcgccacagtcgtggtcacggacagcgaacaggcgaatcggatcatggatatcagggccgatcttccagacctcgagcacgtcatcgtcacagacgcccgcgttccaggcacgcagttttgggatgatgtcctcgccctcgcgtcgtctgctgaataccacccgatggacgcttcgcccgacgatccggctgtcctcatctacacctccggcacaaccgggtccgcgaagggggcgcttcacggccatcgcatcctgctcggccacctgcctggcgtcagtcttccgcacgatttcgcgccgcagccgggtgacgtcttctggacgcccgcggattgggcatggattggcgggctgtacgacgtgttgctgccagccctgtgctggggtgtcccggtggtggcgcatcgcatacgcaagttcgatcccgaacgtgccttcgccctaatggagcggtggcgcgttcgcaacgccttcatgcctcccacgtccctcaagatgatgcgccatatcaccgaccccagaagccgatggcatctacacctgcgcacgttggcgacgggcggcgaaccgctcggcgcggaacttctctcgtgggctcgcgaggcgttaggcctctcgattcacgagttctacggccagacggagtgcaatctggttgtcgccaactgcagcgcatgtttccagccgaagccgggttccatgggacgaccggtgccaggccacgatgtggccgtgatcgacgaaaacggccacgtggtatctcctggcgtgatcggcgagatcgccgttcgccgtccgcatccggtgatgttcatcggctattggaaccgccctgaggagaccgccgcgaagttcgtcggggactggctgaagacgggcgatctcggccgcatggacgaggaaggctatctgtggttcgtggggcgcgcggacgacgtcatcacgtcggcgggctaccggatcggcccggtggagatcgaggaggcggcgcttcaacattcggccgtggtcatggcggcggccgttggcacgcccgatcctgttcgcggcgaggtggtgaagctctttgtgaaactccgtgagggcgtgcccgcgaacgagtgcctcaccgcggagcttcagaactgggtcaaggagcgggtgggcgcgcacagctatccgcgggagatcgagttcgtcgacgaacttcccctcacgccgtcgggcaaggtgcgccggcgagcgctgcgcgaacgggaatacgcgcaaaagggcgtcccgctgcccggtaagcgcggctga

SEQ ID NO: 1329 - protein, 545 aa, Rubrobacter xylanophilus DSM 9941
DDFWASLTSRMPRRLDYETLYEGFSWDLPRPYNIGTDVCDRHAWEPGRLALIHDRGDGTAEKWTFRELKLASDRFANALRGLGVERGDRVAVLLSQTPQLPVAHIAVYKLGAVTVPLFALFGEDALRFRLSDSGARVIVTDEEHFEVAASLREELEELEHVVLTGGGRAGALGFDDLVREASPFFRPVETGPDDPAIIIYTSGTTGSPKGALHGHRILLGHLPGVSLPHDLAPRRGDLFWTPADWAWIGGLFDVLFPALHWGLPVLSCRMRRFDPERAFDLMERWGVRNVFLPPTALKMMRAVGSPRSRWRLELETLACGGEPLGEESLAWAREELGLPINEFYGQTECNLVLSNCSAIMPIKPGSMGRPVPGHRVAIIDAEGRELPPGEVGEVAVLRPDPVMMLGYWNNERATEAKFVGDWLRTGDLATRDGEGYFRFVGRDDDVITSSGYRIGPAEIEETLVKHPRVLMAAAVGRPDPVRGEVVKAFVVLREGEGDEALAEELKELVRRRLGAHEYPREVEFVPELPLTATGKIRRNVLRARE

SEQ ID NO: 1330 - protein, 538 aa, alpha proteobacterium BAL199
YEAVRERFRWRIPQRYNIGVDVCDRHADAGAGTALIHIAADGAVVEHSFTELKRQSNRLANVLTAAGLQRGDRVGILMPQRPETAIAHIAAHKAGMVSVPLFTLFGEDALAYRLGDCAAAALVTDRDSLPKIEAIRDHLPSLKLILVADTAKNGSGWRALDLALDAASDAFTPVDTSADDPAVIIYTSGTTGQPKGALHAHRVLLGHLPGVEFPQEFFPAPGDRFWTPADWAWIGGLLDVLLPSLHHGIPVVAHRFAKFDPEAAFDLIARHRVRNSFLPPTALKLMRQVPDPLARHALAMRSIGSGGETLGTELLEWGRSVFGLTINEFYGQTECNLVVGNCASILPVRPGSMGKPVPGHEVAIVDANGIPLPASETGAIAVKRGDPVMFLGYWNNPQATDAKFTGPDKQWMLTGDLGRQDEDGYLHYVGRDDDVITSAGYRIGPGEIEDCLTAHPSVALAAVIGVPDPLRTEAIKACVVLADGVAPSDSLKAEIQNHVKRRLAAHEYPRIVEFVDSLPMTTTGKIMRRVLRERHAAE

SEQ ID NO: 1331 - protein, 530 aa, Stappia aggregata IAM 12614
YDDLSGRFKWEIPDRFNIGVAICDDWAAREPNREALVYTDEDGSATSYTYDDLRRLSNQLANLLTARGVQPGDRIGVLMPQRPETAFAHIAALKLGAISIPLFTLFGEEALEYRLKDSGAKVVITDASGAAKLATIRDRLPELTTVLCADEDVPWAESLHHHMAGHEGTFHPFDTGPDDPAIIIYTSGTTGQPKGALHGHRVLLGHLPGVEMSHDLLGQPGDRIWTPADWAWIGGLLDVLMPALYLGVPVVACRFRKFTAEAAFQLLQDQKIRNTFLPPTALKMMRQVEAPEKRWRFTLRSVASGGETLGAELIDWGRRTFGLTINEFYGQTECNMIVSSCARLMEARPGIMGRPVPGHHVSVVSDKGEELPAGTLGNIAVKRPDPVMFLNYWNNMEATEKKFAGDWLLTGDTGIKDDTGWIRFVGRDDDVITSSGYRIGPGEIEDCLIKHPAVAMAGVVGKPDSQRTEIVKAYIVLKKGFEPTDKLAGEIADFVKTRLAAHEYPREVAFVDALPLTTTGKVIRRELRAR

SEQ ID NO: 1332 - protein, 530 aa, Methylobacterium sp. 4-46
YEAFRSGFRWRIPERYNIAVDVCDRWAAADPQRPALLDVSADGRVETWSFAALREASDRFANALRALGIARGDRVAVLLPQSPAVLIAHLAVYKLGAVALPLAVVFGPDALLHRLGDSGAKAVVTHAGGVAKLLPLRDALPELALVVSTDGPGDGALGFAALLEAAAPALAPVETGPDDPALMIYTSGTTGPPKGALHGHRVLLGHLPGFAMMHDFMPRPGDRMWTPADWAWAGGLLNALLPSLHHGVAVVARKAEKFEPEEALRLIADHAVANAFVPPTALRMLRTVARPRARFDLSRLRTLASAGEMLGPETFAWARDALGLTVNEAYGQTECNLVLASCAALGLARAGSTGKPVPGHRVAVIRPDGTAADPDEIGQIAVARPDPVMFLGYWRDEAATARKFLGDWMTTGDQGRVDADGYVHFVGRDDDVITSSGYRIGPGEIEDCLLRHPAVALAAAVGKPDPVRTEIVKAFVVLRPGFAASAALATEIQDFVRRHLSAHEYPREIAFRSSLPLTTTGKIIRRVLRD

SEQ ID NO: 1333 - protein, 520 aa, Rhodobacterales bacterium HTCC2654
WAALRRAFRWTVPDGFNMADACCDSWARDEPGRVAVTHVGHETRDWTFGELKDASDRLAGAFADAGVGRGDRVGVLLGQSPETLIAHLATWKRGGISIPLFSLFGPDALAFRLADSGTKAVVTDAAGAEKLAAVRGELPDLAQVFAVGGGTGRDFWAEVEAASPVDPVPVGAEDPAVIIYTSGTTGPPKGALHAHRFLIGHLPSVELHHEGFPHPGDVGWTPADWAWIGGLMDMAMPCLYHGVRLVSCRMRKFDADEAYRLIADQRVRNLFLPPTALKLMRQAEVPEDVDIRTIGSGGEALGADLLAWAQDALGVTINEFYGQTECNLVLASCAGSMAVKPGSMGQAVPGHEVAVIDAEGQVVAPGTVGEIAVKRPDPVMFLGYWNLPEKTAAKFTGDWMRTGDLGVCDEDGYFTYVSRDDDVITSAGYRIGPTEIETCLTGHPDVVMAAAVGVPDETRGEVVKAYVVLRDGAATEGLADRLIQRVREKVSPHVAPRIVEFVDDLPMTATGKIMRRSLRD

SEQ ID NO: 1334 - protein, 580 aa, Artificial
  Substituion in SEQ ID NO 1327
MPCHREMKGAIEHEEVVLMDDLWTVDGDDLRKLPYGAMYAKFRWPTPDRLNIAEWACRRHARVCPDAPAIWYDVDGGSAEMWTFGHLWRTTSRLAWALLRGLGVPTGGRVAILLPQSPQLAAAHLASYAIGAIAVPLFTLFGTDALRYRLQDSGATVVVTDSEQANRIMDIRADLPDLEHVIVTDARVPGTQFWDDVLALASSAEYHPMDASPDDPAVLIYTSGTTGSAKGALHGHRILLGHLPGVSLPHDFAPQPGDVFWTPADWAWIGGLYDVLLPALCWGVPVVAHRIRKFDPERAFALMERWRVRNAFMPPTSLKMMRHITDPRSRWHLHLRTLATGGEPLGAELLSWAREALGLSIHEFYGQTECNLVVANCSACFQPKPGSMGRPVPGHDVAVIDENGHVISPGVIGEIAVRRPHPVMFIGYWNRPEETAAKFVGDWLKTGDLGRMDEEGYLWFVGRADDVITSAGYRIGPVEIEEAALQHSAVVMAAAVGTPDPVRGEVVKLFVKLREGVPANECLTAELQNWVKERVGAHSYPREIEFVDELPLTPSGKVRRRALREREYAQKGVPLPGKRG

SEQ ID NO: 1335 - protein, 580 aa, Artificial
  Substituion in SEQ ID NO 1327
MPCHREMKGAIEHEEVVLMDELWTVDGDDLRKLPYGAMYAKFRWPTPDRLNIAEWACRRHARVCPDAPAIWYDVDGGSAEMWTFGHLWRTTSRLAWALLRGLGVPTGGRVAILLPQSPQLAAAHLASYAIGAIAVPLFTLFGTDALRYRLQDSGATVVVTDSEQANRIMDIRADLPDLEHVIVTDARVPGTQFWDDVLALASSAEYHPMDASPDDPAVLIYTSGTTGSAKGALHGHRILLGHLPGVSLPHDFAPQPGDVFWTPADWAWIGGLYDVLLPALCWGVPVVAHRIRKFDPERAFALMERWRVRNAFMPPTSLKMMRHITDPRSRWHLHLRTLATGGEPLGAELLSWAREALGLSIHEFYGQTECNLVVANCSACFQPKPGSMGRPVPGHDVAVIDENGHVVSPGVIGEIAVRRPHPVMFIGYWNRPEETAAKFVGDWLKTGDLGRMDEEGYLWFVGRADDVITSAGYRIGPVEIEEAALQHSAVVMAAAVGTPDPVRGEVVKLFVKLREGVPANECLTAELQNWVKERVGAHSYPREIEFVDELPLTPSGKVRRRALREREYAQKGVPLPGKRG

SEQ ID NO: 1336 - protein, 580 aa, Artificial
  Substituion in SEQ ID NO 1327
MPCHREMKGAIEHEEVVLMDDLWTVDGDDLRKLPYGAMYAKFRWPTPDRLNIAEWACRRHARVCPDAPAIWYDVDGGSAEMWTFGHLWRTTSRLAWALLRGLGVPTGGRVAILLPQSPQLAAAHLASYAIGAIAVPLFTLFGTDALRYRLQDSGATVVVTDSEQANRIMDIRADLPDLEHVIVTDARVPGTQFWDDVLALASSAEYHPMDASPDDPAVLIYTSGTTGSAKGALHGHRILLGHLPGVSLPHDFAPQPGDVFWTPADWAWIGGLYDVLLPALCWGVPVVAHRIRKFDPERAFALMERWRVRNAFMPPTSLKMMRHITDPRSRWHLHLRTLATGGEPLGAELLSWAREALGLSIHEFYGQTECNLVVANCSACFQPKPGSMGRPVPGHDVAVIDENGHVVSPGVIGEIAVRRPHPVMFIGYWNRPEDTAAKFVGDWLKTGDLGRMDEEGYLWFVGRADDVITSAGYRIGPVEIEEAALQHSAVVMAAAVGTPDPVRGEVVKLFVKLREGVPANECLTAELQNWVKERVGAHSYPREIEFVDELPLTPSGKVRRRALREREYAQKGVPLPGKRG

SEQ ID NO: 1337 - protein, 580 aa, Artificial
  Substituion in SEQ ID NO 1327
MPCHREMKGAIEHEEVVLMDDLWTVDGDDLRKLPYGAMYAKFRWPTPDRLNIAEWACRRHARVCPDAPAIWYDVDGGSAEMWTFGHLWRTTSRLAWALLRGLGVPTGGRVAILLPQSPQLAAAHLASYAIGAIAVPLFTLFGTDALRYRLQDSGATVVVTDSEQANRIMDIRADLPDLEHVIVTDARVPGTQFWDDVLALASSAEYHPMDASPDDPAVLIYTSGTTGSAKGALHGHRILLGHLPGVSLPHDFAPQPGDVFWTPADWAWIGGLYDVLLPALCWGVPVVAHRIRKFDPERAFALMERWRVRNAFMPPTSLKMMRHITDPRSRWHLHLRTLATGGEPLGAELLSWAREALGLSIHEFYGQTECNLVVANCSACFQPKPGSMGRPVPGHDVAVIDENGHVVSPGVIGEIAVRRPHPVMFIGYWNRPEETAAKFVGDWLKTGDLGRMDEEGYLWFVGRADDVITSAGYRIGPVEIEEAALQHSAVVMAAAVGTPDPVRGEVVKLFVKLRDGVPANECLTAELQNWVKERVGAHSYPREIEFVDELPLTPSGKVRRRALREREYAQKGVPLPGKRG

SEQ ID NO: 1338 - protein, 580 aa, Artificial
  Substituion in SEQ ID NO 1327
MPCHREMKGAIEHEEVVLMDDLWTVDGDDLRKLPYGAMYAKFRWPTPDRLNIAEWACRRHARVCPDAPAIWYDVDGGSAEMWTFGHLWRTTSRLAWALLRGLGVPTGGRVAILLPQSPQLAAAHLASYAIGAIAVPLFTLFGTDALRYRLQDSGATVVVTDSEQANRIMDIRADLPDLEHVIVTDARVPGTQFWDDVLALASSAEYHPMDASPDDPAVLIYTSGTTGSAKGALHGHRILLGHLPGVSLPHDFAPQPGDVFWTPADWAWIGGLYDVILPALCWGVPVVAHRIRKFDPERAFALMERWRVRNAFMPPTSLKMMRHITDPRSRWHLHLRTLATGGEPLGAELLSWAREALGLSIHEFYGQTECNLVVANCSACFQPKPGSMGRPVPGHDVAVIDENGHVVSPGVIGEIAVRRPHPVMFIGYWNRPEETAAKFVGDWLKTGDLGRMDEEGYLWFVGRADDVITSAGYRIGPVEIEEAALQHSAVVMAAAVGTPDPVRGEVVKLFVKLREGVPANECLTAELQNWVKERVGAHSYPREIEFVDELPLTPSGKVRRRALREREYAQKGVPLPGKRG

SEQ ID NO: 1339 - DNA, 1743 bp, Artificial
  Substituion in SEQ ID NO 1328
gtgccgtgccacagggaaatgaaaggcgcgatcgagcatgaggaggtcgttctcatggacgacctttggacggtggatggggacgatctgcggaagttgccctacggggcgatgtatgccaagtttcggtggcccacgccggatcggctgaatatcgccgagtgggcgtgtcgcaggcatgcgcgggtgtgcccggatgcgcccgctatttggtatgacgtcgacggtgggtcggcggaaatgtggaccttcggccatctgtggcgcaccacaagcaggttggcctgggctcttctgagaggccttggggttccaaccgggggacgggtggccatccttctcccgcagtctccccagctcgcggcggcccacctcgcctcgtacgctatcggggcgatcgcggtacccctgttcacgctgttcggaacggacgcgcttcgctaccggctccaggatagcggcgccacagtcgtggtcacggacagcgaacaggcgaatcggatcatggatatcagggccgatcttccagacctcgagcacgtcatcgtcacagacgcccgcgttccaggcacgcagttttgggatgatgtcctcgccctcgcgtcgtctgctgaataccacccgatggacgcttcgcccgacgatccggctgtcctcatctacacctccggcacaaccgggtccgcgaagggggcgcttcacggccatcgcatcctgctcggccacctgcctggcgtcagtcttccgcacgatttcgcgccgcagccgggtgacgtcttctggacgcccgcggattgggcatggattggcgggctgtacgacgtgttgctgccagccctgtgctggggtgtcccggtggtggcgcatcgcatacgcaagttcgatcccgaacgtgccttcgccctaatggagcggtggcgcgttcgcaacgccttcatgcctcccacgtccctcaagatgatgcgccatatcaccgaccccagaagccgatggcatctacacctgcgcacgttggcgacgggcggcgaaccgctcggcgcggaacttctctcgtgggctcgcgaggcgttaggcctctcgattcacgagttctacggccagacggagtgcaatctggttgtcgccaactgcagcgcatgtttccagccgaagccgggttccatgggacgaccggtgccaggccacgatgtggccgtgatcgacgaaaacggccacgtgatttctcctggcgtgatcggcgagatcgccgttcgccgtccgcatccggtgatgttcatcggctattggaaccgccctgaggagaccgccgcgaagttcgtcggggactggctgaagacgggcgatctcggccgcatggacgaggaaggctatctgtggttcgtggggcgcgcggacgacgtcatcacgtcggcgggctaccggatcggcccggtggagatcgaggaggcggcgcttcaacattcggccgtggtcatggcggcggccgttggcacgcccgatcctgttcgcggcgaggtggtgaagctctttgtgaaactccgtgagggcgtgcccgcgaacgagtgcctcaccgcggagcttcagaactgggtcaaggagcgggtgggcgcgcacagctatccgcgggagatcgagttcgtcgacgaacttcccctcacgccgtcgggcaaggtgcgccggcgagcgctgcgcgaacgggaatacgcgcaaaagggcgtcccgctgcccggtaagcgcggctga

SEQ ID NO: 1340 - DNA, 1743 bp, Artificial
  Substituion in SEQ ID NO 1328
gtgccgtgccacagggaaatgaaaggcgcgatcgagcatgaggaggtcgttctcatggacgaactttggacggtggatggggacgatctgcggaagttgccctacggggcgatgtatgccaagtttcggtggcccacgccggatcggctgaatatcgccgagtgggcgtgtcgcaggcatgcgcgggtgtgcccggatgcgcccgctatttggtatgacgtcgacggtgggtcggcggaaatgtggaccttcggccatctgtggcgcaccacaagcaggttggcctgggctcttctgagaggccttggggttccaaccgggggacgggtggccatccttctcccgcagtctccccagctcgcggcggcccacctcgcctcgtacgctatcggggcgatcgcggtacccctgttcacgctgttcggaacggacgcgcttcgctaccggctccaggatagcggcgccacagtcgtggtcacggacagcgaacaggcgaatcggatcatggatatcagggccgatcttccagacctcgagcacgtcatcgtcacagacgcccgcgttccaggcacgcagttttgggatgatgtcctcgccctcgcgtcgtctgctgaataccacccgatggacgcttcgcccgacgatccggctgtcctcatctacacctccggcacaaccgggtccgcgaagggggcgcttcacggccatcgcatcctgctcggccacctgcctggcgtcagtcttccgcacgatttcgcgccgcagccgggtgacgtcttctggacgcccgcggattgggcatggattggcgggctgtacgacgtgttgctgccagccctgtgctggggtgtcccggtggtggcgcatcgcatacgcaagttcgatcccgaacgtgccttcgccctaatggagcggtggcgcgttcgcaacgccttcatgcctcccacgtccctcaagatgatgcgccatatcaccgaccccagaagccgatggcatctacacctgcgcacgttggcgacgggcggcgaaccgctcggcgcggaacttctctcgtgggctcgcgaggcgttaggcctctcgattcacgagttctacggccagacggagtgcaatctggttgtcgccaactgcagcgcatgtttccagccgaagccgggttccatgggacgaccggtgccaggccacgatgtggccgtgatcgacgaaaacggccacgtggtatctcctggcgtgatcggcgagatcgccgttcgccgtccgcatccggtgatgttcatcggctattggaaccgccctgaggagaccgccgcgaagttcgtcggggactggctgaagacgggcgatctcggccgcatggacgaggaaggctatctgtggttcgtggggcgcgcggacgacgtcatcacgtcggcgggctaccggatcggcccggtggagatcgaggaggcggcgcttcaacattcggccgtggtcatggcggcggccgttggcacgcccgatcctgttcgcggcgaggtggtgaagctctttgtgaaactccgtgagggcgtgcccgcgaacgagtgcctcaccgcggagcttcagaactgggtcaaggagcgggtgggcgcgcacagctatccgcgggagatcgagttcgtcgacgaacttcccctcacgccgtcgggcaaggtgcgccggcgagcgctgcgcgaacgggaatacgcgcaaaagggcgtcccgctgcccggtaagcgcggctga

SEQ ID NO: 1341 - DNA, 1743 bp, Artificial
  Substituion in SEQ ID NO 1328
gtgccgtgccacagggaaatgaaaggcgcgatcgagcatgaggaggtcgttctcatggacgacctttggacggtggatggggacgatctgcggaagttgccctacggggcgatgtatgccaagtttcggtggcccacgccggatcggctgaatatcgccgagtgggcgtgtcgcaggcatgcgcgggtgtgcccggatgcgcccgctatttggtatgacgtcgacggtgggtcggcggaaatgtggaccttcggccatctgtggcgcaccacaagcaggttggcctgggctcttctgagaggccttggggttccaaccgggggacgggtggccatccttctcccgcagtctccccagctcgcggcggcccacctcgcctcgtacgctatcggggcgatcgcggtacccctgttcacgctgttcggaacggacgcgcttcgctaccggctccaggatagcggcgccacagtcgtggtcacggacagcgaacaggcgaatcggatcatggatatcagggccgatcttccagacctcgagcacgtcatcgtcacagacgcccgcgttccaggcacgcagttttgggatgatgtcctcgccctcgcgtcgtctgctgaataccacccgatggacgcttcgcccgacgatccggctgtcctcatctacacctccggcacaaccgggtccgcgaagggggcgcttcacggccatcgcatcctgctcggccacctgcctggcgtcagtcttccgcacgatttcgcgccgcagccgggtgacgtcttctggacgcccgcggattgggcatggattggcgggctgtacgacgtgttgctgccagccctgtgctggggtgtcccggtggtggcgcatcgcatacgcaagttcgatcccgaacgtgccttcgccctaatggagcggtggcgcgttcgcaacgccttcatgcctcccacgtccctcaagatgatgcgccatatcaccgaccccagaagccgatggcatctacacctgcgcacgttggcgacgggcggcgaaccgctcggcgcggaacttctctcgtgggctcgcgaggcgttaggcctctcgattcacgagttctacggccagacggagtgcaatctggttgtcgccaactgcagcgcatgtttccagccgaagccgggttccatgggacgaccggtgccaggccacgatgtggccgtgatcgacgaaaacggccacgtggtatctcctggcgtgatcggcgagatcgccgttcgccgtccgcatccggtgatgttcatcggctattggaaccgccctgaggataccgccgcgaagttcgtcggggactggctgaagacgggcgatctcggccgcatggacgaggaaggctatctgtggttcgtggggcgcgcggacgacgtcatcacgtcggcgggctaccggatcggcccggtggagatcgaggaggcggcgcttcaacattcggccgtggtcatggcggcggccgttggcacgcccgatcctgttcgcggcgaggtggtgaagctctttgtgaaactccgtgagggcgtgcccgcgaacgagtgcctcaccgcggagcttcagaactgggtcaaggagcgggtgggcgcgcacagctatccgcgggagatcgagttcgtcgacgaacttcccctcacgccgtcgggcaaggtgcgccggcgagcgctgcgcgaacgggaatacgcgcaaaagggcgtcccgctgcccggtaagcgcggctga

SEQ ID NO: 1342 - DNA, 1743 bp, Artificial
  Substituion in SEQ ID NO 1328
gtgccgtgccacagggaaatgaaaggcgcgatcgagcatgaggaggtcgttctcatggacgacctttggacggtggatggggacgatctgcggaagttgccctacggggcgatgtatgccaagtttcggtggcccacgccggatcggctgaatatcgccgagtgggcgtgtcgcaggcatgcgcgggtgtgcccggatgcgcccgctatttggtatgacgtcgacggtgggtcggcggaaatgtggaccttcggccatctgtggcgcaccacaagcaggttggcctgggctcttctgagaggccttggggttccaaccgggggacgggtggccatccttctcccgcagtctccccagctcgcggcggcccacctcgcctcgtacgctatcggggcgatcgcggtacccctgttcacgctgttcggaacggacgcgcttcgctaccggctccaggatagcggcgccacagtcgtggtcacggacagcgaacaggcgaatcggatcatggatatcagggccgatcttccagacctcgagcacgtcatcgtcacagacgcccgcgttccaggcacgcagttttgggatgatgtcctcgccctcgcgtcgtctgctgaataccacccgatggacgcttcgcccgacgatccggctgtcctcatctacacctccggcacaaccgggtccgcgaagggggcgcttcacggccatcgcatcctgctcggccacctgcctggcgtcagtcttccgcacgatttcgcgccgcagccgggtgacgtcttctggacgcccgcggattgggcatggattggcgggctgtacgacgtgttgctgccagccctgtgctggggtgtcccggtggtggcgcatcgcatacgcaagttcgatcccgaacgtgccttcgccctaatggagcggtggcgcgttcgcaacgccttcatgcctcccacgtccctcaagatgatgcgccatatcaccgaccccagaagccgatggcatctacacctgcgcacgttggcgacgggcggcgaaccgctcggcgcggaacttctctcgtgggctcgcgaggcgttaggcctctcgattcacgagttctacggccagacggagtgcaatctggttgtcgccaactgcagcgcatgtttccagccgaagccgggttccatgggacgaccggtgccaggccacgatgtggccgtgatcgacgaaaacggccacgtggtatctcctggcgtgatcggcgagatcgccgttcgccgtccgcatccggtgatgttcatcggctattggaaccgccctgaggagaccgccgcgaagttcgtcggggactggctgaagacgggcgatctcggccgcatggacgaggaaggctatctgtggttcgtggggcgcgcggacgacgtcatcacgtcggcgggctaccggatcggcccggtggagatcgaggaggcggcgcttcaacattcggccgtggtcatggcggcggccgttggcacgcccgatcctgttcgcggcgaggtggtgaagctctttgtgaaactccgtgatggcgtgcccgcgaacgagtgcctcaccgcggagcttcagaactgggtcaaggagcgggtgggcgcgcacagctatccgcgggagatcgagttcgtcgacgaacttcccctcacgccgtcgggcaaggtgcgccggcgagcgctgcgcgaacgggaatacgcgcaaaagggcgtcccgctgcccggtaagcgcggctga

SEQ ID NO: 1343 - DNA, 1743 bp, Artificial
  Substituion in SEQ ID NO 1328
gtgccgtgccacagggaaatgaaaggcgcgatcgagcatgaggaggtcgttctcatggacgacctttggacggtggatggggacgatctgcggaagttgccctacggggcgatgtatgccaagtttcggtggcccacgccggatcggctgaatatcgccgagtgggcgtgtcgcaggcatgcgcgggtgtgcccggatgcgcccgctatttggtatgacgtcgacggtgggtcggcggaaatgtggaccttcggccatctgtggcgcaccacaagcaggttggcctgggctcttctgagaggccttggggttccaaccgggggacgggtggccatccttctcccgcagtctccccagctcgcggcggcccacctcgcctcgtacgctatcggggcgatcgcggtacccctgttcacgctgttcggaacggacgcgcttcgctaccggctccaggatagcggcgccacagtcgtggtcacggacagcgaacaggcgaatcggatcatggatatcagggccgatcttccagacctcgagcacgtcatcgtcacagacgcccgcgttccaggcacgcagttttgggatgatgtcctcgccctcgcgtcgtctgctgaataccacccgatggacgcttcgcccgacgatccggctgtcctcatctacacctccggcacaaccgggtccgcgaagggggcgcttcacggccatcgcatcctgctcggccacctgcctggcgtcagtcttccgcacgatttcgcgccgcagccgggtgacgtcttctggacgcccgcggattgggcatggattggcgggctgtacgacgtgattctgccagccctgtgctggggtgtcccggtggtggcgcatcgcatacgcaagttcgatcccgaacgtgccttcgccctaatggagcggtggcgcgttcgcaacgccttcatgcctcccacgtccctcaagatgatgcgccatatcaccgaccccagaagccgatggcatctacacctgcgcacgttggcgacgggcggcgaaccgctcggcgcggaacttctctcgtgggctcgcgaggcgttaggcctctcgattcacgagttctacggccagacggagtgcaatctggttgtcgccaactgcagcgcatgtttccagccgaagccgggttccatgggacgaccggtgccaggccacgatgtggccgtgatcgacgaaaacggccacgtggtatctcctggcgtgatcggcgagatcgccgttcgccgtccgcatccggtgatgttcatcggctattggaaccgccctgaggagaccgccgcgaagttcgtcggggactggctgaagacgggcgatctcggccgcatggacgaggaaggctatctgtggttcgtggggcgcgcggacgacgtcatcacgtcggcgggctaccggatcggcccggtggagatcgaggaggcggcgcttcaacattcggccgtggtcatggcggcggccgttggcacgcccgatcctgttcgcggcgaggtggtgaagctctttgtgaaactccgtgagggcgtgcccgcgaacgagtgcctcaccgcggagcttcagaactgggtcaaggagcgggtgggcgcgcacagctatccgcgggagatcgagttcgtcgacgaacttcccctcacgccgtcgggcaaggtgcgccggcgagcgctgcgcgaacgggaatacgcgcaaaagggcgtcccgctgcccggtaagcgcggctga

SEQ ID NO: 1344 - protein, 531 aa, Alicyclobacillus acidocaldarius
MAAQRTTRSCPRTRRSSSCTGRPMTPRGMQRRWNRLQNEGEGKMHRTSSVSVAGHLRNWIGGAWRDAEASEYLDVFDPATAEVIAQVPLSTQQDVEMAVAAAAEAFREWSKTPVPRRARIFFRYQQLLVDHWDELARLIVRENGKSYKDAYGEVQRAIENVEFAASAPTLLMGEQLANIATSLDSGMYRYPLGVVAGITPFNFPMMVPCWMFPLAIVCGNTFVLKPSERTPLLAQRLAELLEEAGLPSGVLNIVHGAREVVQGLIEHPTVRAISFVGSQPVAAYVYREAAAHGKRVQALAGAKNHTIVMPDADLDEAIPQIISAAFGSAGERCMACSVVVAVGSIADRLVEGLKSAADQIRIGNGLDEDVLLGPVIRAEHRDRTLQYIDLGIQEGAVLVRDGRQDRVDANGYFVGPTIFDHVRPSMKIWQDEIFAPVLSVVRVGTLDEAIALANRSRFANGACIFTNSASAIRKFREEIDAGMLGVNIGVPAPMAFFPFSGWKDSFYGDLHANGKDGVAFYTRRKMITARV

SEQ ID NO: 1345 - DNA, 1596 bp, Alicyclobacillus acidocaldarius
gtggcagcccagcgaaccacccggtcgtgccctcgcacgaggagatcgtccagctgtaccggcaggcctatgacgccacgtgggatgcagcgccgatggaatcgcttacaaaatgagggggaagggaagatgcataggacgtcgtccgtgagtgtagccgggcacctgcgcaattggatcggcggcgcgtggcgagacgcggaagccagcgaatacctcgacgtcttcgatccggcgaccgcggaggtcatcgctcaggtgccgctgtcgacacaacaagacgtggaaatggctgtggcggcggctgcggaagcgtttcgggaatggagcaagacccctgtacctcgccgcgcgcgaatcttctttcgctatcagcaactgctcgtcgatcattgggacgaactcgcccgactgatcgtccgcgagaacggcaagagctacaaggacgcctacggggaggtgcagcgcgcgatcgaaaacgtcgagtttgccgcgagcgcgccgacgctcctcatgggagaacaattggccaatatcgcgacatccttggactcgggcatgtaccggtacccacttggcgtggtggcaggcatcacgccgttcaactttccgatgatggtcccttgctggatgtttcctctggccatcgtctgcgggaacacgttcgtgttgaagccttccgagcggacgccgcttttggcccagcggttggccgagctgctcgaggaggcgggcctgccctccggggtcctcaacattgtgcacggcgcccgagaggtcgttcaaggcctgatcgaacatccgacggttcgcgccatctcgttcgtcggatcgcagccggtggccgcgtacgtgtaccgcgaagcggcagcccacggcaagcgcgtgcaggcgctggcaggcgccaagaatcacaccatcgtgatgccggacgcggatctggacgaagccatcccccagatcatctcggccgcgttcggctcggcgggcgagcgctgcatggcctgttccgtcgtcgtggcagtaggttccatcgcagatcgcctcgtcgaaggcctgaagtccgctgccgatcagatccgcatcggcaacggcctagacgaagatgtcctgcttggtcccgtcatccgggcagaacatcgagatcggacgttgcagtacatcgatctcggcatccaggagggcgcggtccttgtgcgcgacggacgccaggatcgcgtggatgcaaacgggtacttcgtcggacccacgattttcgatcacgtccgcccttccatgaagatctggcaagacgagatctttgcgcccgtgctgtcggtcgtgcgggtgggcacgctggacgaggccatcgcgttggccaaccggtcccggtttgcgaacggagcctgcatcttcacgaacagcgcgtccgccattcgcaagttccgcgaggaaatcgacgcaggaatgcttggggtcaacatcggtgttcctgctcccatggcgttcttccccttctcggggtggaaggattccttctacggcgatctgcacgccaacggcaaggacggcgtggcgttttacacgcgccgaaagatgatcacggcaagagtatga

SEQ ID NO: 1346 - protein, 484 aa, Geobacillus kaustophilus HTA426
SSVTETKTLKNFIGGQWVASTSGKEEVVPNPATGEVLAKVPLSSREELDAAVAAAKEAFREWRKVPVPRRARILFRYQQLLVEHWDELARLVTLENGKVYEDAYGEVQRGIECVEFAAGIPTLMMGQQLPDIATDIESGMYRYPLGVVAGITPFNFPMMVPCWMFPLAIACGNTFVLKPSERTPMLANRLAELFTEAGLPPGVLNIVHGAHEVVGGILEHKDIKAVSFVGSQPVAEYVYKTAAAHGKRVQALAGAKNHSIVMPDADLDMAVTNIINAAFGSAGERCMACSVVVAVGDIADELVRRLKEAADRIQIGNGLDKGVFLGPVIRESHKERTIKYIEIGEKEGALLVRDGRRDSATSGQGYFIGPTIFDHVKPGMTIWTDEIFAPVLSVVRARDLDEAIEIANRSEFANGACIYTDSAKAIRQFREEIDAGMLGVNVAVPAPMAFFPFSGYKNSFYGDLHANGRDGVEFYTRKKMVTAR

SEQ ID NO: 1347 - protein, 484 aa, Geobacillus thermodenitrificans NG80-2
SSVTETKTLKNFIGGQWVASTSGKEEIVPNPATGEVLAKVPISSREELDAAVAAAKEAFREWRKVPVPRRARILFRYQQLLVEHWEELARLVTLENGKVYEDAYGEVQRGIECVEFAAGIPTLMMGQQLPDIATGIESGMYRYPLGVVAGITPFNFPMMVPCWMFPLAIACGNTFVLKPSERTPLLANRLAELFTEAGLPAGVLNIVHGAHEVVNGILEHKDIKAVSFVGSQPVAEYVYKTAAAYGKRVQALAGAKNHSIVMPDADLDMAVTNIINAAFGSAGERCMACSVVVAVGDIADELVERLKKAADRIQIGNGLDQGVFLGPVIRESHKERTIKYIEIGEREGALLVRDGRRDAATSGKGYFVGPTIFDHVKPGMTIWTDEIFAPVLSVVRARDLDEAIEIANRSEFANGACIYTDSAKAIRQFREEIDAGMLGVNVAVPAPMAFFPFSGYKNSFYGDLHANGRDGVEFYTRKKMVTAR

SEQ ID NO: 1348 - protein, 476 aa, Geobacillus thermodenitrificans NG80-2
LKNYIGGQWVESRSAKTEAVPNPATGEVLAYVPISTREDLDRAVAAAKEAFKTWSKTPVPRRARILFKYQQLLVEHWEELARLVTLENGKSYNEAYGEIQRGIECVEFAAGAPTLMMGRQLPSIATGIESGMYRYPIGVVGGITPFNFPMMVPCWMFPLAIACGNTFVLKPSERTPMLANRLAELFKEAGLPDGVLNIVHGAHDVVNGLLEHPDVKAISFVGSQPVGEYVYKTAAAHGKRVQALTGAKNHSIVMPDADLKVAVREIINAAFGSAGERCMAASVVVAVGDIADELVERLVAAANEIKIGNGLEESVFLGPVIREAHKQRTVNYIELGEKEGAILVRDGRKDAAVQGEGYFIGPTIFDRVTTDMTIWKDEIFAPVLSIVRVSTLDEAIEVANKSPFANGACIYTRDGGNVRKFRDEIDAGMLGVNLGVPAPMAFFPFSGWKNSFYGDLHANGMDGVEFYTRKKMLTAR

SEQ ID NO: 1349 - protein, 476 aa, Geobacillus kaustophilus HTA426
LKNYIGGQWVESRSGKTEAVPNPATGEVLAYVPISSREELDEAVRAAKEAFKTWRKTPVPRRARILFKYQQLLVEHWEELARLVTLENGKSYNEAYGEVQRGIECVEFAAGAPTLMMGRQLPDIATGIESGMYRYPIGVVGGITPFNFPMMVPCWMFPLAIACGNTFVLKPSERTPMLANRLAELFKEAGLPDGVLNIVHGAHDVVNGLLEHPDVKAISFVGSQPVGEYVYKTAAAHGKRVQALTGAKNHSIVMPDADLNVAVREIINAAFGSAGERCMAASVVVAVGEIADELVEKLVAAANELKIGNGLEESVFLGPVIREAHKQRTVKYIELGEKEGAILVRDGRKDAAVQDNGYFIGPTIFDRVTTDMTIWKDEIFAPVLSIVRVETLDEAIEVANKSPFANGACIYTRDGGNVRKFREEIDAGMLGVNLGVPAPMAFFPFSGWKNSFYGDLHANGMDGVEFYTRKKMMTSR

SEQ ID NO: 1350 - protein, 483 aa, Bacillus halodurans C-125
ANLATGEKLKNFIGGQWVESDSGKTEAVPNPATGEILAHVPISNREDLDRAVSVAKEAFKTWGKTPVPRRARVLFKYQQLLVENWEELARLVTLENGKSYKEAYGEVQRGIECVEFAAGAPSLMMGKQLPDIATNIESGMYRYPIGVVGGITPFNFPMMVPCWMFPLAIACGNTFVLKPSERTPLLANRLAELFTEAGLPEGVLNIVHGAHDVVNGLLEHPDVKAISFVGSQPVAEYVYKTASQHGKRVQALAGAKNHSIVMPDADLDGAVNQIVNAAYGSAGERCMAAAVVVAVGEVAEPLMEKLQKAVNEITIGNGLDDDVFLGPVIRESHKQKTENYIELGEKEGATLVRDGRKDNVSKDGYFLGPTLFDNVTTEMTIWKEEIFAPVLSVVRVESLDEAIQLTNQSEFANGACLYTTNGSSVRKFREEIDAGMLGINLGVPAPMAFFPFSGWKNSFYGDLHANGTDGVEFYTRKKMITAR

SEQ ID NO: 1351 - protein, 531 aa, Artificial
  Substituion in SEQ ID NO 1344
MAAQRTTRSCPRTRRSSSCTGRPMTPRGMQRRWNRLQNEGEGKMHRTSSVSVAGHLRNWIGGAWREAEASEYLDVFDPATAEVIAQVPLSTQQDVEMAVAAAAEAFREWSKTPVPRRARIFFRYQQLLVDHWDELARLIVRENGKSYKDAYGEVQRAIENVEFAASAPTLLMGEQLANIATSLDSGMYRYPLGVVAGITPFNFPMMVPCWMFPLAIVCGNTFVLKPSERTPLLAQRLAELLEEAGLPSGVLNIVHGAREVVQGLIEHPTVRAISFVGSQPVAAYVYREAAAHGKRVQALAGAKNHTIVMPDADLDEAIPQIISAAFGSAGERCMACSVVVAVGSIADRLVEGLKSAADQIRIGNGLDEDVLLGPVIRAEHRDRTLQYIDLGIQEGAVLVRDGRQDRVDANGYFVGPTIFDHVRPSMKIWQDEIFAPVLSVVRVGTLDEAIALANRSRFANGACIFTNSASAIRKFREEIDAGMLGVNIGVPAPMAFFPFSGWKDSFYGDLHANGKDGVAFYTRRKMITARV

SEQ ID NO: 1352 - protein, 531 aa, Artificial
  Substituion in SEQ ID NO 1344
MAAQRTTRSCPRTRRSSSCTGRPMTPRGMQRRWNRLQNEGEGKMHRTSSVSVAGHLRNWIGGAWRDAEASEYLDVFDPATAEVIAQVPLSTQQDVEMAVAAAAEAFREWSKTPVPRRARIFFRYQQLLVDHWDELARLIVRENGKSYKDAYGEVQRAIENVEFAASAPTLLMGEQLANIATSLDSGMYRYPLGVVAGITPFNFPMMVPCWMFPLAIVCGNTFVLKPSERTPLLAQRLAELLEEAGLPSGVLNIVHGAREVVNGLIEHPTVRAISFVGSQPVAAYVYREAAAHGKRVQALAGAKNHTIVMPDADLDEAIPQIISAAFGSAGERCMACSVVVAVGSIADRLVEGLKSAADQIRIGNGLDEDVLLGPVIRAEHRDRTLQYIDLGIQEGAVLVRDGRQDRVDANGYFVGPTIFDHVRPSMKIWQDEIFAPVLSVVRVGTLDEAIALANRSRFANGACIFTNSASAIRKFREEIDAGMLGVNIGVPAPMAFFPFSGWKDSFYGDLHANGKDGVAFYTRRKMITARV

SEQ ID NO: 1353 - protein, 531 aa, Artificial
  Substituion in SEQ ID NO 1344
MAAQRTTRSCPRTRRSSSCTGRPMTPRGMQRRWNRLQNEGEGKMHRTSSVSVAGHLRNWIGGAWRDAEASEYLDVFDPATAEVIAQVPLSTQQDVEMAVAAAAEAFREWSKTPVPRRARIFFRYQQLLVDHWDELARLIVRENGKSYKDAYGEVQRAIENVEFAASAPTLLMGEQLANIATSLDSGMYRYPLGVVAGITPFNFPMMVPCWMFPLAIVCGNTFVLKPSERTPLLAQRLAELLEEAGLPSGVLNIVHGAREVVQGLIEHPTVRAISFVGSQPVAAYVYREAAAHGKRVQALAGAKNHTIVMPDADLDEAIPQIISAAFGSAGERCMACSVVVAVGSIADRLVEGLKSAADQIKIGNGLDEDVLLGPVIRAEHRDRTLQYIDLGIQEGAVLVRDGRQDRVDANGYFVGPTIFDHVRPSMKIWQDEIFAPVLSVVRVGTLDEAIALANRSRFANGACIFTNSASAIRKFREEIDAGMLGVNIGVPAPMAFFPFSGWKDSFYGDLHANGKDGVAFYTRRKMITARV

SEQ ID NO: 1354 - protein, 531 aa, Artificial
  Substituion in SEQ ID NO 1344
MAAQRTTRSCPRTRRSSSCTGRPMTPRGMQRRWNRLQNEGEGKMHRTSSVSVAGHLRNWIGGAWRDAEASEYLDVFDPATAEVIAQVPLSTQQDVEMAVAAAAEAFREWSKTPVPRRARIFFRYQQLLVDHWDELARLIVRENGKSYKDAYGEVQRAIENVEFAASAPTLLMGEQLANIATSLDSGMYRYPLGVVAGITPFNFPMMVPCWMFPLAIVCGNTFVLKPSERTPLLAQRLAELLEEAGLPSGVLNIVHGAREVVQGLIEHPTVRAISFVGSQPVAAYVYREAAAHGKRVQALAGAKNHTIVMPDADLDEAIPQIISAAFGSAGERCMACSVVVAVGSIADRLVEGLKSAADQIRIGNGLDEDVLLGPVIRAEHRDRTLQYIDLGIQEGAVLVRDGRQDRVDANGYFVGPTIFDHVRPSMKIWQDEIFAPVLSVVRVGTLDEAIALANRSRFANGACIFTNSASAIRKFREEIDAGMLGVNIGVPAPMAFFPFSGWKDSFYGDLHANGKDGVAFYTRRKMITARI

SEQ ID NO: 1355 - protein, 531 aa, Artificial
  Substituion in SEQ ID NO 1344
MAAQRTTKSCPRTRRSSSCTGRPMTPRGMQRRWNRLQNEGEGKMHRTSSVSVAGHLRNWIGGAWRDAEASEYLDVFDPATAEVIAQVPLSTQQDVEMAVAAAAEAFREWSKTPVPRRARIFFRYQQLLVDHWDELARLIVRENGKSYKDAYGEVQRAIENVEFAASAPTLLMGEQLANIATSLDSGMYRYPLGVVAGITPFNFPMMVPCWMFPLAIVCGNTFVLKPSERTPLLAQRLAELLEEAGLPSGVLNIVHGAREVVQGLIEHPTVRAISFVGSQPVAAYVYREAAAHGKRVQALAGAKNHTIVMPDADLDEAIPQIISAAFGSAGERCMACSVVVAVGSIADRLVEGLKSAADQIRIGNGLDEDVLLGPVIRAEHRDRTLQYIDLGIQEGAVLVRDGRQDRVDANGYFVGPTIFDHVRPSMKIWQDEIFAPVLSVVRVGTLDEAIALANRSRFANGACIFTNSASAIRKFREEIDAGMLGVNIGVPAPMAFFPFSGWKDSFYGDLHANGKDGVAFYTRRKMITARV

SEQ ID NO: 1356 - DNA, 1596 bp, Artificial
  Substituion in SEQ ID NO 1345
gtggcagcccagcgaaccacccggtcgtgccctcgcacgaggagatcgtccagctgtaccggcaggcctatgacgccacgtgggatgcagcgccgatggaatcgcttacaaaatgagggggaagggaagatgcataggacgtcgtccgtgagtgtagccgggcacctgcgcaattggatcggcggcgcgtggcgagaagcggaagccagcgaatacctcgacgtcttcgatccggcgaccgcggaggtcatcgctcaggtgccgctgtcgacacaacaagacgtggaaatggctgtggcggcggctgcggaagcgtttcgggaatggagcaagacccctgtacctcgccgcgcgcgaatcttctttcgctatcagcaactgctcgtcgatcattgggacgaactcgcccgactgatcgtccgcgagaacggcaagagctacaaggacgcctacggggaggtgcagcgcgcgatcgaaaacgtcgagtttgccgcgagcgcgccgacgctcctcatgggagaacaattggccaatatcgcgacatccttggactcgggcatgtaccggtacccacttggcgtggtggcaggcatcacgccgttcaactttccgatgatggtcccttgctggatgtttcctctggccatcgtctgcgggaacacgttcgtgttgaagccttccgagcggacgccgcttttggcccagcggttggccgagctgctcgaggaggcgggcctgccctccggggtcctcaacattgtgcacggcgcccgagaggtcgttcaaggcctgatcgaacatccgacggttcgcgccatctcgttcgtcggatcgcagccggtggccgcgtacgtgtaccgcgaagcggcagcccacggcaagcgcgtgcaggcgctggcaggcgccaagaatcacaccatcgtgatgccggacgcggatctggacgaagccatcccccagatcatctcggccgcgttcggctcggcgggcgagcgctgcatggcctgttccgtcgtcgtggcagtaggttccatcgcagatcgcctcgtcgaaggcctgaagtccgctgccgatcagatccgcatcggcaacggcctagacgaagatgtcctgcttggtcccgtcatccgggcagaacatcgagatcggacgttgcagtacatcgatctcggcatccaggagggcgcggtccttgtgcgcgacggacgccaggatcgcgtggatgcaaacgggtacttcgtcggacccacgattttcgatcacgtccgcccttccatgaagatctggcaagacgagatctttgcgcccgtgctgtcggtcgtgcgggtgggcacgctggacgaggccatcgcgttggccaaccggtcccggtttgcgaacggagcctgcatcttcacgaacagcgcgtccgccattcgcaagttccgcgaggaaatcgacgcaggaatgcttggggtcaacatcggtgttcctgctcccatggcgttcttccccttctcggggtggaaggattccttctacggcgatctgcacgccaacggcaaggacggcgtggcgttttacacgcgccgaaagatgatcacggcaagagtatga

SEQ ID NO: 1357 - DNA, 1596 bp, Artificial
  Substituion in SEQ ID NO 1345
gtggcagcccagcgaaccacccggtcgtgccctcgcacgaggagatcgtccagctgtaccggcaggcctatgacgccacgtgggatgcagcgccgatggaatcgcttacaaaatgagggggaagggaagatgcataggacgtcgtccgtgagtgtagccgggcacctgcgcaattggatcggcggcgcgtggcgagacgcggaagccagcgaatacctcgacgtcttcgatccggcgaccgcggaggtcatcgctcaggtgccgctgtcgacacaacaagacgtggaaatggctgtggcggcggctgcggaagcgtttcgggaatggagcaagacccctgtacctcgccgcgcgcgaatcttctttcgctatcagcaactgctcgtcgatcattgggacgaactcgcccgactgatcgtccgcgagaacggcaagagctacaaggacgcctacggggaggtgcagcgcgcgatcgaaaacgtcgagtttgccgcgagcgcgccgacgctcctcatgggagaacaattggccaatatcgcgacatccttggactcgggcatgtaccggtacccacttggcgtggtggcaggcatcacgccgttcaactttccgatgatggtcccttgctggatgtttcctctggccatcgtctgcgggaacacgttcgtgttgaagccttccgagcggacgccgcttttggcccagcggttggccgagctgctcgaggaggcgggcctgccctccggggtcctcaacattgtgcacggcgcccgagaggtcgttaatggcctgatcgaacatccgacggttcgcgccatctcgttcgtcggatcgcagccggtggccgcgtacgtgtaccgcgaagcggcagcccacggcaagcgcgtgcaggcgctggcaggcgccaagaatcacaccatcgtgatgccggacgcggatctggacgaagccatcccccagatcatctcggccgcgttcggctcggcgggcgagcgctgcatggcctgttccgtcgtcgtggcagtaggttccatcgcagatcgcctcgtcgaaggcctgaagtccgctgccgatcagatccgcatcggcaacggcctagacgaagatgtcctgcttggtcccgtcatccgggcagaacatcgagatcggacgttgcagtacatcgatctcggcatccaggagggcgcggtccttgtgcgcgacggacgccaggatcgcgtggatgcaaacgggtacttcgtcggacccacgattttcgatcacgtccgcccttccatgaagatctggcaagacgagatctttgcgcccgtgctgtcggtcgtgcgggtgggcacgctggacgaggccatcgcgttggccaaccggtcccggtttgcgaacggagcctgcatcttcacgaacagcgcgtccgccattcgcaagttccgcgaggaaatcgacgcaggaatgcttggggtcaacatcggtgttcctgctcccatggcgttcttccccttctcggggtggaaggattccttctacggcgatctgcacgccaacggcaaggacggcgtggcgttttacacgcgccgaaagatgatcacggcaagagtatga

SEQ ID NO: 1358 - DNA, 1596 bp, Artificial
  Substituion in SEQ ID NO 1345
gtggcagcccagcgaaccacccggtcgtgccctcgcacgaggagatcgtccagctgtaccggcaggcctatgacgccacgtgggatgcagcgccgatggaatcgcttacaaaatgagggggaagggaagatgcataggacgtcgtccgtgagtgtagccgggcacctgcgcaattggatcggcggcgcgtggcgagacgcggaagccagcgaatacctcgacgtcttcgatccggcgaccgcggaggtcatcgctcaggtgccgctgtcgacacaacaagacgtggaaatggctgtggcggcggctgcggaagcgtttcgggaatggagcaagacccctgtacctcgccgcgcgcgaatcttctttcgctatcagcaactgctcgtcgatcattgggacgaactcgcccgactgatcgtccgcgagaacggcaagagctacaaggacgcctacggggaggtgcagcgcgcgatcgaaaacgtcgagtttgccgcgagcgcgccgacgctcctcatgggagaacaattggccaatatcgcgacatccttggactcgggcatgtaccggtacccacttggcgtggtggcaggcatcacgccgttcaactttccgatgatggtcccttgctggatgtttcctctggccatcgtctgcgggaacacgttcgtgttgaagccttccgagcggacgccgcttttggcccagcggttggccgagctgctcgaggaggcgggcctgccctccggggtcctcaacattgtgcacggcgcccgagaggtcgttcaaggcctgatcgaacatccgacggttcgcgccatctcgttcgtcggatcgcagccggtggccgcgtacgtgtaccgcgaagcggcagcccacggcaagcgcgtgcaggcgctggcaggcgccaagaatcacaccatcgtgatgccggacgcggatctggacgaagccatcccccagatcatctcggccgcgttcggctcggcgggcgagcgctgcatggcctgttccgtcgtcgtggcagtaggttccatcgcagatcgcctcgtcgaaggcctgaagtccgctgccgatcagatcaaaatcggcaacggcctagacgaagatgtcctgcttggtcccgtcatccgggcagaacatcgagatcggacgttgcagtacatcgatctcggcatccaggagggcgcggtccttgtgcgcgacggacgccaggatcgcgtggatgcaaacgggtacttcgtcggacccacgattttcgatcacgtccgcccttccatgaagatctggcaagacgagatctttgcgcccgtgctgtcggtcgtgcgggtgggcacgctggacgaggccatcgcgttggccaaccggtcccggtttgcgaacggagcctgcatcttcacgaacagcgcgtccgccattcgcaagttccgcgaggaaatcgacgcaggaatgcttggggtcaacatcggtgttcctgctcccatggcgttcttccccttctcggggtggaaggattccttctacggcgatctgcacgccaacggcaaggacggcgtggcgttttacacgcgccgaaagatgatcacggcaagagtatga

SEQ ID NO: 1359 - DNA, 1596 bp, Artificial
  Substituion in SEQ ID NO 1345
gtggcagcccagcgaaccacccggtcgtgccctcgcacgaggagatcgtccagctgtaccggcaggcctatgacgccacgtgggatgcagcgccgatggaatcgcttacaaaatgagggggaagggaagatgcataggacgtcgtccgtgagtgtagccgggcacctgcgcaattggatcggcggcgcgtggcgagacgcggaagccagcgaatacctcgacgtcttcgatccggcgaccgcggaggtcatcgctcaggtgccgctgtcgacacaacaagacgtggaaatggctgtggcggcggctgcggaagcgtttcgggaatggagcaagacccctgtacctcgccgcgcgcgaatcttctttcgctatcagcaactgctcgtcgatcattgggacgaactcgcccgactgatcgtccgcgagaacggcaagagctacaaggacgcctacggggaggtgcagcgcgcgatcgaaaacgtcgagtttgccgcgagcgcgccgacgctcctcatgggagaacaattggccaatatcgcgacatccttggactcgggcatgtaccggtacccacttggcgtggtggcaggcatcacgccgttcaactttccgatgatggtcccttgctggatgtttcctctggccatcgtctgcgggaacacgttcgtgttgaagccttccgagcggacgccgcttttggcccagcggttggccgagctgctcgaggaggcgggcctgccctccggggtcctcaacattgtgcacggcgcccgagaggtcgttcaaggcctgatcgaacatccgacggttcgcgccatctcgttcgtcggatcgcagccggtggccgcgtacgtgtaccgcgaagcggcagcccacggcaagcgcgtgcaggcgctggcaggcgccaagaatcacaccatcgtgatgccggacgcggatctggacgaagccatcccccagatcatctcggccgcgttcggctcggcgggcgagcgctgcatggcctgttccgtcgtcgtggcagtaggttccatcgcagatcgcctcgtcgaaggcctgaagtccgctgccgatcagatccgcatcggcaacggcctagacgaagatgtcctgcttggtcccgtcatccgggcagaacatcgagatcggacgttgcagtacatcgatctcggcatccaggagggcgcggtccttgtgcgcgacggacgccaggatcgcgtggatgcaaacgggtacttcgtcggacccacgattttcgatcacgtccgcccttccatgaagatctggcaagacgagatctttgcgcccgtgctgtcggtcgtgcgggtgggcacgctggacgaggccatcgcgttggccaaccggtcccggtttgcgaacggagcctgcatcttcacgaacagcgcgtccgccattcgcaagttccgcgaggaaatcgacgcaggaatgcttggggtcaacatcggtgttcctgctcccatggcgttcttccccttctcggggtggaaggattccttctacggcgatctgcacgccaacggcaaggacggcgtggcgttttacacgcgccgaaagatgatcacggcaagaatttga

SEQ ID NO: 1360 - DNA, 1596 bp, Artificial
  Substituion in SEQ ID NO 1345
gtggcagcccagcgaaccaccaaatcgtgccctcgcacgaggagatcgtccagctgtaccggcaggcctatgacgccacgtgggatgcagcgccgatggaatcgcttacaaaatgagggggaagggaagatgcataggacgtcgtccgtgagtgtagccgggcacctgcgcaattggatcggcggcgcgtggcgagacgcggaagccagcgaatacctcgacgtcttcgatccggcgaccgcggaggtcatcgctcaggtgccgctgtcgacacaacaagacgtggaaatggctgtggcggcggctgcggaagcgtttcgggaatggagcaagacccctgtacctcgccgcgcgcgaatcttctttcgctatcagcaactgctcgtcgatcattgggacgaactcgcccgactgatcgtccgcgagaacggcaagagctacaaggacgcctacggggaggtgcagcgcgcgatcgaaaacgtcgagtttgccgcgagcgcgccgacgctcctcatgggagaacaattggccaatatcgcgacatccttggactcgggcatgtaccggtacccacttggcgtggtggcaggcatcacgccgttcaactttccgatgatggtcccttgctggatgtttcctctggccatcgtctgcgggaacacgttcgtgttgaagccttccgagcggacgccgcttttggcccagcggttggccgagctgctcgaggaggcgggcctgccctccggggtcctcaacattgtgcacggcgcccgagaggtcgttcaaggcctgatcgaacatccgacggttcgcgccatctcgttcgtcggatcgcagccggtggccgcgtacgtgtaccgcgaagcggcagcccacggcaagcgcgtgcaggcgctggcaggcgccaagaatcacaccatcgtgatgccggacgcggatctggacgaagccatcccccagatcatctcggccgcgttcggctcggcgggcgagcgctgcatggcctgttccgtcgtcgtggcagtaggttccatcgcagatcgcctcgtcgaaggcctgaagtccgctgccgatcagatccgcatcggcaacggcctagacgaagatgtcctgcttggtcccgtcatccgggcagaacatcgagatcggacgttgcagtacatcgatctcggcatccaggagggcgcggtccttgtgcgcgacggacgccaggatcgcgtggatgcaaacgggtacttcgtcggacccacgattttcgatcacgtccgcccttccatgaagatctggcaagacgagatctttgcgcccgtgctgtcggtcgtgcgggtgggcacgctggacgaggccatcgcgttggccaaccggtcccggtttgcgaacggagcctgcatcttcacgaacagcgcgtccgccattcgcaagttccgcgaggaaatcgacgcaggaatgcttggggtcaacatcggtgttcctgctcccatggcgttcttccccttctcggggtggaaggattccttctacggcgatctgcacgccaacggcaaggacggcgtggcgttttacacgcgccgaaagatgatcacggcaagagtatga

SEQ ID NO: 1361 - protein, 402 aa, Alicyclobacillus acidocaldarius
MSRVFGEFKVPEAVYAGRGALQMLPQASSSLGKRALIVTDEVMERLGYVAQMQRMLAEAGVQADVFAEVNTEPTDVHVETGVRAFLQHGCDHLIALGGGSAIDAAKGISVMAVHEGYIGDYMGGRRTFDKAPYPVIAIPTTAGTGSEVTSVTVITNTKDDVKMMIRQPALLPKVAIVDPQLTVSSPPHVTASSGVDALCHAIEAFISRRSHPLTDALATDAAKKIVTYLERAYNDGQDLEAREGMAIAALEAGMAFTNSSVCLVHGMSRPIGALFHVPHGFANAMLLPTVLEFRLDDYAPRLALLARALNPELSGASDGEAAAWVVRRVKTLAERLQIPNLKTWGIERDAFERALDKMANDALASGSPANHPVVPSHEEIVQLYRQAYDATWDAAPMESLTK

SEQ ID NO: 1362 - DNA, 1209 bp, Alicyclobacillus acidocaldarius
gtgagcagggtgtttggagagttcaaagtcccggaggctgtgtacgccgggcgcggggcgctgcagatgctgccgcaggcgtcgtccagcctgggaaagcgggccctcatcgtgacggatgaggtgatggaacggctcggctacgtggcacagatgcagaggatgttggccgaggcgggcgttcaagccgacgtgttcgcggaggtgaacacggagccgaccgacgtgcacgtagagaccggcgtgcgcgcgttcttgcagcacggctgcgaccacctcatcgcgctcggcgggggcagcgccatcgacgccgcgaagggaatttccgtcatggcggtgcacgagggatacatcggcgactatatgggcggccgcaggacgttcgacaaggcgccgtaccccgtgatcgcgatcccgacgactgccggcacgggatccgaggtcaccagcgtaacggttatcaccaataccaaggacgacgtcaagatgatgatccggcaacccgcgctattgcccaaggtcgcgatcgtggacccccagctcaccgtctcgtcgcctccccatgtcaccgcttcgagcggcgtggacgcgctgtgccacgcgatcgaggcgtttatctcgagaagaagccatccgctgacggacgcgctggccacggacgctgcgaagaagatagtgacctacttggagcgggcgtacaacgacggacaggacctggaggcgcgcgaggggatggcgatcgcggcgctggaagctggcatggccttcacgaattcatccgtgtgcctcgtgcatggcatgtcccgccccatcggcgccttgtttcacgtaccacatggttttgccaacgccatgctccttccgactgtgctggagttccgacttgatgactacgcgccgaggctggcgctgctcgcgcgggccctgaatccagaactgtccggtgcgtcggacggcgaagccgcggcgtgggtcgtgaggcgagtgaaaacgcttgccgagaggctccagatcccaaatctcaagacttggggaattgaaagggatgccttcgagcgcgcgctggataagatggcgaacgatgccctcgcgagtggcagcccagcgaaccacccggtcgtgccctcgcacgaggagatcgtccagctgtaccggcaggcctatgacgccacgtgggatgcagcgccgatggaatcgcttacaaaatga

SEQ ID NO: 1363 - protein, 387 aa, Geobacillus thermodenitrificans NG80-2
ELLVPNRVIYGRDTFREVGRQAKALGTKALIVSDPVMENIGLVARCEQYLREAGLPLATYTRVDTEPTDVHVKEALDVCRSEQCDVIVAIGGGSSIDAAKAVAVMMTNEGTISDYVGNAKMFTKKPVPLIAIPTTAGTGSEVTKVTVIIDTKTDVKMMISQPALLPAVAIVDPLLTVSCPPSVTAATGVDALCHSIEAYISRRAHPVTDVLALSAIEAIIGHLRRAYENGQDIEAREKMAIAAMKAGMAFSNASVTLVHGMSRPIGALFHVPHGVSNAMLLPGVLEFTKESAIERLAVIARLINPQLKDVSNAEAADALVEEVKQLCRDLHIPNMKTWGIDKTAFDKAVDKMAADALASGSPSNNPRVPTHEEIVALYHICYDYRYD

SEQ ID NO: 1364 - protein, 393 aa, Geobacillus kaustophilus HTA426
ELLVPSRVVYGRDTFAEVGPQAKALGTKALIVSDPVMEKIGLVARCEQYLQQVGMTFAKYTGVDTEPTDVHVKEALDVCRSEQCDVIIALGGGSSIDAAKAVSVMMTNEGTISDYVGNQKRFTEKPLPLIAIPTTAGTGSEVTKVTVIIDTKMDVKMMISQPALLPAVAIVDPLLTVSCPPSVTAATGVDALCHAIEAYISRRAHPVTDALALSAIEAIVGHLRRAYENGQDIEAREKMAIAAMKAGMAFSNASVTLVHGMSRPIGALFHVPHGVSNAMLLPGVLEFTKDSAIERLAVIVRIIKPPLKDVSDTEAAEALVEEVKQLCRDLHIPNMKTWGIDKTAFDKVVDKMAADALASGSPANNPKVPTHEEIVALYHYCYDYQYDTKTVSS

SEQ ID NO: 1365 - protein, 388 aa, Bacillus sp. NRRL B-14911
FRVPESIFYGRGSFENLGSQAALKGKKALIISDNVMDQLGYVTEGRALLHVAGVQSEVYLGIASEPTDKYVSEALDLFKSEQCDLVISIGGGSCIDTAKAIAVLAVNGGSIGDYLGGKKLAQQTPVPHIAIPTTAGTGSEATDVTVITNTFNNVKMMIKQPAFLPDAAIVDPLLTVSSPKNITAATGIDALSHAIEAYLSKKAHPMTDTMAISAMKLIAENILTAYNDGGNLDARERMSLGSLQAGMAFSNASVCLVHGMSRPIGALFHVPHGISNAMLLPAVLEFSQEACVERLADIGRIFRPDIVSGDGVKAAEIAVQSVKELCRKLNIPNLKEWGIDGEAFEKAVGKMAADAIDSGSPANNPKVPSQLELEELYHICYDYHFSSA

SEQ ID NO: 1366 - protein, 382 aa, Bacillus coagulans 36D1
FRTPQTILYGKQAFEKIGEEAARRGKKALIVTDKIMAGLGNADACQHILQEAGVKSAVYAGVNSEPVDHYVSEALALFQQESCDLLVSLGGGSCIDTAKAVAVVATNGGYIGDYMGARKIAEKPPVAHIAVPTTAGTGSEATDATIITNTANDVKMMIKQPAFMPAVAIVDPVLSKSSPKSVTAATGVDALSHAIEAYISRRAHPLTDTLALSAMRLIIPNLKSAYEDGENMEARDAMALGSLQAGMAFSNASVCLVHGMSRPIGALFHVPHGVSNAMLLPAVLEFSKSVCLERLADIGKIFSPEAKDLSGKEAADLAVRAVKQLCLDLNIPNLRGWGIPQQPFESAINKMASDALASGSPQNNPRVPSQKEIEDLYLVCYD

SEQ ID NO: 1367 - protein, 383 aa, Bacillus cereus ATCC 14579
EFRMPKSVLYGRNSLEKLGEQSKKLGKRAFIVTDTIMEKLGYVEKCMQQLNKKGITVSTYNKVDAEPTNIHVLEALSLCKEEKCDFIIGIGGGSCIDAAKAVAVLYTNGGEVEDYVQKDIKIENKPLPLIAIPTTSGTGSEVTSVAVITNKKTDVKMMMKHPSFIPKVAIIDPVLTSSLPPQITAATGIDALCHAIEAYISKFSQPLTDVLALSAIESIMKYLRIAYEDGRNMEAREAMMIASLQAGIAFSNASVTLVHGMSRPVGALFHVPHGISNAILLPTVLEFTKTSAMKRLAKIGRSLNKDLYSNSDEEVADYTLGEIKKLCFDLRIPNLKEYGIDEIEFENAISKMASDAIESGSPANNPRVPSYDEIKELYRECFN

SEQ ID NO: 1368 - protein, 402 aa, Artificial
  Substituion in SEQ ID NO 1361
MSRVFGEFKVPEAVYAGRGALQMLPQASSSLGKRALIVTDEVMERLGYVAQMQRMLAEAGVQADVFAEVNTEPTDVHVETGVRAFLQHGCDHLIALGGGSAIDAAKGISVMAVHEGYIGDYMGGRRTFDKAPYPVIAIPTTAGTGSEVTSVTVITNTKDDVKMMIRQPALLPKVAIVDPQLTVSSPPHVTASSGVDALCHAIEAFISRRSHPLTDALATDAAKRIVTYLERAYNDGQDLEAREGMAIAALEAGMAFTNSSVCLVHGMSRPIGALFHVPHGFANAMLLPTVLEFRLDDYAPRLALLARALNPELSGASDGEAAAWVVRRVKTLAERLQIPNLKTWGIERDAFERALDKMANDALASGSPANHPVVPSHEEIVQLYRQAYDATWDAAPMESLTK

SEQ ID NO: 1369 - protein, 402 aa, Artificial
  Substituion in SEQ ID NO 1361
MSRVFGEFKVPEAVYAGRGALQMLPQASSSLGKRALIVTDEVMERLGYVAQMQRMLAEAGVQADVFAEVNTEPTDVHVETGVRAFLQHGCDHLIALGGGSAIDAAKGISVMAVHEGYIGDYMGGRRTFDKAPYPVIAIPTTAGTGSEVTSVTVITNTKDDVKMMIRQPALLPKVAIVDPQLTVSSPPHVTASSGVDALCHAIEAFISRRSHPLTDALATDAAKKIVTYLERAYNDGQDLEAREGMAIAALEAGMAFTNSSVCLVHGMSRPIGALFHVPHGFANAMLLPTVLEFRLDDYAPRLALLARALNPELSGASDGEAAAWVVRRVKTLAERLQIPNLKTWGIERDAFERALDKMANDALASGSPANHPVVPSHDEIVQLYRQAYDATWDAAPMESLTK

SEQ ID NO: 1370 - protein, 402 aa, Artificial
  Substituion in SEQ ID NO 1361
MSRVFGEFKVPEAVYAGRGALQMLPQASSSLGKRALIVTDEVMERLGYVAQMQRMLAEAGVQADVFAEVNTEPTDVHVETGVRAFLQHGCDHLIALGGGSAIDAAKGISVMAVHEGYIGDYMGGRRTFDKAPYPVIAIPTTAGTGSEVTSVTVITNTKDDVKMMIRQPALLPKVAIVDPQLTVSSPPHVTASSGVDALCHAIEAFISRRSHPLTDALATDAAKKIVTYLERAYNDGQDLEAREGMAIAALEAGMAFTNSSVCLVHGMSRPIGALFHVPHGFANAMLLPTVLEFRLDDYAPRLAILARALNPELSGASDGEAAAWVVRRVKTLAERLQIPNLKTWGIERDAFERALDKMANDALASGSPANHPVVPSHEEIVQLYRQAYDATWDAAPMESLTK

SEQ ID NO: 1371 - protein, 402 aa, Artificial
  Substituion in SEQ ID NO 1361
MSRVFGEFKVPEAVYAGRGALQMLPQASSSLGKRALIVTDEVMERLGYVAQMQRMLAEAGVNADVFAEVNTEPTDVHVETGVRAFLQHGCDHLIALGGGSAIDAAKGISVMAVHEGYIGDYMGGRRTFDKAPYPVIAIPTTAGTGSEVTSVTVITNTKDDVKMMIRQPALLPKVAIVDPQLTVSSPPHVTASSGVDALCHAIEAFISRRSHPLTDALATDAAKKIVTYLERAYNDGQDLEAREGMAIAALEAGMAFTNSSVCLVHGMSRPIGALFHVPHGFANAMLLPTVLEFRLDDYAPRLALLARALNPELSGASDGEAAAWVVRRVKTLAERLQIPNLKTWGIERDAFERALDKMANDALASGSPANHPVVPSHEEIVQLYRQAYDATWDAAPMESLTK

SEQ ID NO: 1372 - protein, 402 aa, Artificial
  Substituion in SEQ ID NO 1361
MSRVFGEFKVPEAVYAGRGALQMLPQASSSLGKRALIVTDEVMERLGYVAQMQRMLAEAGVQADVFAEVNTEPTDVHVETGVRAFLQHGCDHLIALGGGSAIDAAKGISVMAVHEGYIGDYMGGRRTFEKAPYPVIAIPTTAGTGSEVTSVTVITNTKDDVKMMIRQPALLPKVAIVDPQLTVSSPPHVTASSGVDALCHAIEAFISRRSHPLTDALATDAAKKIVTYLERAYNDGQDLEAREGMAIAALEAGMAFTNSSVCLVHGMSRPIGALFHVPHGFANAMLLPTVLEFRLDDYAPRLALLARALNPELSGASDGEAAAWVVRRVKTLAERLQIPNLKTWGIERDAFERALDKMANDALASGSPANHPVVPSHEEIVQLYRQAYDATWDAAPMESLTK

SEQ ID NO: 1373 - DNA, 1209 bp, Artificial
  Substituion in SEQ ID NO 1362
gtgagcagggtgtttggagagttcaaagtcccggaggctgtgtacgccgggcgcggggcgctgcagatgctgccgcaggcgtcgtccagcctgggaaagcgggccctcatcgtgacggatgaggtgatggaacggctcggctacgtggcacagatgcagaggatgttggccgaggcgggcgttcaagccgacgtgttcgcggaggtgaacacggagccgaccgacgtgcacgtagagaccggcgtgcgcgcgttcttgcagcacggctgcgaccacctcatcgcgctcggcgggggcagcgccatcgacgccgcgaagggaatttccgtcatggcggtgcacgagggatacatcggcgactatatgggcggccgcaggacgttcgacaaggcgccgtaccccgtgatcgcgatcccgacgactgccggcacgggatccgaggtcaccagcgtaacggttatcaccaataccaaggacgacgtcaagatgatgatccggcaacccgcgctattgcccaaggtcgcgatcgtggacccccagctcaccgtctcgtcgcctccccatgtcaccgcttcgagcggcgtggacgcgctgtgccacgcgatcgaggcgtttatctcgagaagaagccatccgctgacggacgcgctggccacggacgctgcgaagcgtatagtgacctacttggagcgggcgtacaacgacggacaggacctggaggcgcgcgaggggatggcgatcgcggcgctggaagctggcatggccttcacgaattcatccgtgtgcctcgtgcatggcatgtcccgccccatcggcgccttgtttcacgtaccacatggttttgccaacgccatgctccttccgactgtgctggagttccgacttgatgactacgcgccgaggctggcgctgctcgcgcgggccctgaatccagaactgtccggtgcgtcggacggcgaagccgcggcgtgggtcgtgaggcgagtgaaaacgcttgccgagaggctccagatcccaaatctcaagacttggggaattgaaagggatgccttcgagcgcgcgctggataagatggcgaacgatgccctcgcgagtggcagcccagcgaaccacccggtcgtgccctcgcacgaggagatcgtccagctgtaccggcaggcctatgacgccacgtgggatgcagcgccgatggaatcgcttacaaaatga

SEQ ID NO: 1374 - DNA, 1209 bp, Artificial
  Substituion in SEQ ID NO 1362
gtgagcagggtgtttggagagttcaaagtcccggaggctgtgtacgccgggcgcggggcgctgcagatgctgccgcaggcgtcgtccagcctgggaaagcgggccctcatcgtgacggatgaggtgatggaacggctcggctacgtggcacagatgcagaggatgttggccgaggcgggcgttcaagccgacgtgttcgcggaggtgaacacggagccgaccgacgtgcacgtagagaccggcgtgcgcgcgttcttgcagcacggctgcgaccacctcatcgcgctcggcgggggcagcgccatcgacgccgcgaagggaatttccgtcatggcggtgcacgagggatacatcggcgactatatgggcggccgcaggacgttcgacaaggcgccgtaccccgtgatcgcgatcccgacgactgccggcacgggatccgaggtcaccagcgtaacggttatcaccaataccaaggacgacgtcaagatgatgatccggcaacccgcgctattgcccaaggtcgcgatcgtggacccccagctcaccgtctcgtcgcctccccatgtcaccgcttcgagcggcgtggacgcgctgtgccacgcgatcgaggcgtttatctcgagaagaagccatccgctgacggacgcgctggccacggacgctgcgaagaagatagtgacctacttggagcgggcgtacaacgacggacaggacctggaggcgcgcgaggggatggcgatcgcggcgctggaagctggcatggccttcacgaattcatccgtgtgcctcgtgcatggcatgtcccgccccatcggcgccttgtttcacgtaccacatggttttgccaacgccatgctccttccgactgtgctggagttccgacttgatgactacgcgccgaggctggcgctgctcgcgcgggccctgaatccagaactgtccggtgcgtcggacggcgaagccgcggcgtgggtcgtgaggcgagtgaaaacgcttgccgagaggctccagatcccaaatctcaagacttggggaattgaaagggatgccttcgagcgcgcgctggataagatggcgaacgatgccctcgcgagtggcagcccagcgaaccacccggtcgtgccctcgcacgatgagatcgtccagctgtaccggcaggcctatgacgccacgtgggatgcagcgccgatggaatcgcttacaaaatga

SEQ ID NO: 1375 - DNA, 1209 bp, Artificial
  Substituion in SEQ ID NO 1362
gtgagcagggtgtttggagagttcaaagtcccggaggctgtgtacgccgggcgcggggcgctgcagatgctgccgcaggcgtcgtccagcctgggaaagcgggccctcatcgtgacggatgaggtgatggaacggctcggctacgtggcacagatgcagaggatgttggccgaggcgggcgttcaagccgacgtgttcgcggaggtgaacacggagccgaccgacgtgcacgtagagaccggcgtgcgcgcgttcttgcagcacggctgcgaccacctcatcgcgctcggcgggggcagcgccatcgacgccgcgaagggaatttccgtcatggcggtgcacgagggatacatcggcgactatatgggcggccgcaggacgttcgacaaggcgccgtaccccgtgatcgcgatcccgacgactgccggcacgggatccgaggtcaccagcgtaacggttatcaccaataccaaggacgacgtcaagatgatgatccggcaacccgcgctattgcccaaggtcgcgatcgtggacccccagctcaccgtctcgtcgcctccccatgtcaccgcttcgagcggcgtggacgcgctgtgccacgcgatcgaggcgtttatctcgagaagaagccatccgctgacggacgcgctggccacggacgctgcgaagaagatagtgacctacttggagcgggcgtacaacgacggacaggacctggaggcgcgcgaggggatggcgatcgcggcgctggaagctggcatggccttcacgaattcatccgtgtgcctcgtgcatggcatgtcccgccccatcggcgccttgtttcacgtaccacatggttttgccaacgccatgctccttccgactgtgctggagttccgacttgatgactacgcgccgaggctggcgattctcgcgcgggccctgaatccagaactgtccggtgcgtcggacggcgaagccgcggcgtgggtcgtgaggcgagtgaaaacgcttgccgagaggctccagatcccaaatctcaagacttggggaattgaaagggatgccttcgagcgcgcgctggataagatggcgaacgatgccctcgcgagtggcagcccagcgaaccacccggtcgtgccctcgcacgaggagatcgtccagctgtaccggcaggcctatgacgccacgtgggatgcagcgccgatggaatcgcttacaaaatga

SEQ ID NO: 1376 - DNA, 1209 bp, Artificial
  Substituion in SEQ ID NO 1362
gtgagcagggtgtttggagagttcaaagtcccggaggctgtgtacgccgggcgcggggcgctgcagatgctgccgcaggcgtcgtccagcctgggaaagcgggccctcatcgtgacggatgaggtgatggaacggctcggctacgtggcacagatgcagaggatgttggccgaggcgggcgttaatgccgacgtgttcgcggaggtgaacacggagccgaccgacgtgcacgtagagaccggcgtgcgcgcgttcttgcagcacggctgcgaccacctcatcgcgctcggcgggggcagcgccatcgacgccgcgaagggaatttccgtcatggcggtgcacgagggatacatcggcgactatatgggcggccgcaggacgttcgacaaggcgccgtaccccgtgatcgcgatcccgacgactgccggcacgggatccgaggtcaccagcgtaacggttatcaccaataccaaggacgacgtcaagatgatgatccggcaacccgcgctattgcccaaggtcgcgatcgtggacccccagctcaccgtctcgtcgcctccccatgtcaccgcttcgagcggcgtggacgcgctgtgccacgcgatcgaggcgtttatctcgagaagaagccatccgctgacggacgcgctggccacggacgctgcgaagaagatagtgacctacttggagcgggcgtacaacgacggacaggacctggaggcgcgcgaggggatggcgatcgcggcgctggaagctggcatggccttcacgaattcatccgtgtgcctcgtgcatggcatgtcccgccccatcggcgccttgtttcacgtaccacatggttttgccaacgccatgctccttccgactgtgctggagttccgacttgatgactacgcgccgaggctggcgctgctcgcgcgggccctgaatccagaactgtccggtgcgtcggacggcgaagccgcggcgtgggtcgtgaggcgagtgaaaacgcttgccgagaggctccagatcccaaatctcaagacttggggaattgaaagggatgccttcgagcgcgcgctggataagatggcgaacgatgccctcgcgagtggcagcccagcgaaccacccggtcgtgccctcgcacgaggagatcgtccagctgtaccggcaggcctatgacgccacgtgggatgcagcgccgatggaatcgcttacaaaatga

SEQ ID NO: 1377 - DNA, 1209 bp, Artificial
  Substituion in SEQ ID NO 1362
gtgagcagggtgtttggagagttcaaagtcccggaggctgtgtacgccgggcgcggggcgctgcagatgctgccgcaggcgtcgtccagcctgggaaagcgggccctcatcgtgacggatgaggtgatggaacggctcggctacgtggcacagatgcagaggatgttggccgaggcgggcgttcaagccgacgtgttcgcggaggtgaacacggagccgaccgacgtgcacgtagagaccggcgtgcgcgcgttcttgcagcacggctgcgaccacctcatcgcgctcggcgggggcagcgccatcgacgccgcgaagggaatttccgtcatggcggtgcacgagggatacatcggcgactatatgggcggccgcaggacgttcgaaaaggcgccgtaccccgtgatcgcgatcccgacgactgccggcacgggatccgaggtcaccagcgtaacggttatcaccaataccaaggacgacgtcaagatgatgatccggcaacccgcgctattgcccaaggtcgcgatcgtggacccccagctcaccgtctcgtcgcctccccatgtcaccgcttcgagcggcgtggacgcgctgtgccacgcgatcgaggcgtttatctcgagaagaagccatccgctgacggacgcgctggccacggacgctgcgaagaagatagtgacctacttggagcgggcgtacaacgacggacaggacctggaggcgcgcgaggggatggcgatcgcggcgctggaagctggcatggccttcacgaattcatccgtgtgcctcgtgcatggcatgtcccgccccatcggcgccttgtttcacgtaccacatggttttgccaacgccatgctccttccgactgtgctggagttccgacttgatgactacgcgccgaggctggcgctgctcgcgcgggccctgaatccagaactgtccggtgcgtcggacggcgaagccgcggcgtgggtcgtgaggcgagtgaaaacgcttgccgagaggctccagatcccaaatctcaagacttggggaattgaaagggatgccttcgagcgcgcgctggataagatggcgaacgatgccctcgcgagtggcagcccagcgaaccacccggtcgtgccctcgcacgaggagatcgtccagctgtaccggcaggcctatgacgccacgtgggatgcagcgccgatggaatcgcttacaaaatga

SEQ ID NO: 1378 - protein, 534 aa, Alicyclobacillus acidocaldarius
MVRENMATKILVTDDISQAGIDILSGLQGAEVVVRTNLAPDELKEAIADADALVVRSQTRVTRDVIESAKKLKVIGRAGVGVDNIDLEAATRRGILVINAPDGNTIAAAEHTFAMMISLARHIPAAHRDLLQGNWNRKKWIGVELRGKTLAVLGMGRIGTEVAKRAKAFGMTVLGYDPFLTEERAQSLGVKRCDLDTAIREADFITVHTPLTKETHHMIDAGRIAQMKEGVRIINCARGGIIDEVALAEALEAGRVAGAAIDVFEQEPLPMDHPLRRCPNVVLTPHLGASTVEAQENVAIQVAEEIVQVLRDDTFEHAVNLPSLSQRQKERLAPYLALAEQLGLFAAQLAQGAPSSMTVRYAGDAADPDGGYLTRTVLKGFFSFQYNGEVNYVNALRYAEDAGLRVQEVRESRGRVYTNEVEISVATDNGTHRVTGTVLGEYGPRIVELDGYPIDTPIQGILIYTRHEDRPGMIGRIGTLLGDRDINIAGMQVGRRETGGEAVMLLSVDKRVPQDVIDEIAKHPGIRLVRAIEL

SEQ ID NO: 1379 - DNA, 1605 bp, Alicyclobacillus acidocaldarius
gtggtgagagagaacatggcgaccaagattttggtgacggacgacatctcccaggcgggcatcgacatcctctccggccttcagggcgcggaggtcgtggtcaggacgaatctcgcgccggacgagctgaaggaggccattgccgacgcggacgcccttgtggtgcgctcgcagacgcgcgtgacgagggacgtgatcgagagcgcgaaaaagctcaaggtcatcggccgcgcgggcgtcggcgtcgacaacatcgatcttgaggcggccacgcgccgcggcatcctggtcatcaacgccccagatggcaacaccattgcggcggcggagcacaccttcgcgatgatgatcagccttgcgcggcacatccccgcggctcatcgggatctcctccagggcaactggaatcgcaagaagtggattggcgtcgagcttcgcggcaagacgctggcggtcctcggcatgggccgcatcggcacggaggtcgcgaagcgggcgaaggcgttcggcatgactgtcctcgggtatgatccgttcctgacggaggagcgcgcgcagagcctcggcgtcaagcggtgcgatctcgacaccgccatccgcgaggccgacttcatcaccgtgcacacgccgctgacgaaagagacgcatcacatgattgatgccggccggatcgcccagatgaaggagggcgtgcggatcatcaactgcgcgcgcggcggcatcatcgacgaggtggcgctcgcggaggcgctcgaggcggggcgcgtggcgggcgccgccatcgacgtgtttgagcaggagccgctgccgatggatcacccgctcaggcgctgcccgaacgtcgtgttgacgccgcacctcggcgcgtcgacggtggaggcgcaggagaacgtggcgattcaagtggcggaggaaatcgtgcaggtgcttcgcgacgacaccttcgagcacgcggtcaacctgccgagcctgagccagcgccagaaggagcggctcgcgccttatctcgcccttgcggagcaactggggctgtttgcggcgcagctcgcgcagggcgcgccctcgagcatgaccgtgcgctacgccggtgacgcggccgatccagacggcggctacctcacccgcacggtgctgaagggcttcttcagcttccagtacaacggcgaggtcaactacgtcaacgcgctgcggtacgcggaagacgcgggcctgcgtgtgcaggaggtgcgcgagtcgcgcggccgggtgtacacgaacgaggtggagatctcggtcgcgacggacaacggcacgcaccgcgtgacgggcacggtcctcggggagtacgggccgcgcatcgtcgagctcgacgggtaccccattgacacgcccattcaaggcatcctcatctacacgcggcacgaggaccgtcccggcatgatcggccgcatcggcacgctacttggcgatcgcgacatcaacattgccggcatgcaggtgggccggcgggagacgggcggagaagcggtgatgctcctgtccgtcgacaagcgcgtgccgcaggacgtgatcgacgaaatcgcgaagcatccgggcattcgactggtcagggccatcgagctgtga

SEQ ID NO: 1380 - protein, 524 aa, Bacillus coagulans 36D1
ILVTDKVSEEGLKKLYAHKDFIVEHQPGIAPEDLKATIGQYDGLIVRNQTKVTKDIIEASGNLRVIARAGVGVDNIDVDAATRKGIIVVNSPGGNTISATEHTLAMMLSLSRNIPQAHKSAAAGKWEREKFKGVELFKKTLGIIGTGKIGTEVAKRAKAFGMAVLGYDPYLTEERAAKLGIKKATLDEIAAQADFITLHTPLMKETKHLINEAFLAKTKKGVRIINCARGGLVDEQALLQALQEGRVAGAALDVFENEPDITPGLLELPNVTVTPHLGASTREAQVRVAADVSDEIIHIFESEEIRNAINMPQTSGENRERMEPFLLLGEQVAQLGIQLLDEAPEKIEITYAGELLDEDTKLLTRTIIKGILARHLGSTVNLVNALHLLKEQGLTYNLQRNAAFKGFSNYLELALYKKGKQVNIGASIINGFGGRIVKLNDYRVDLRPEQHLLYIRHLDIPGMIGQVGSILGSNDTNIGTMQVGRKEIGGEAIMVLTLDKTASRQVLDQLKEVIGIKAVQTLEL

SEQ ID NO: 1381 - protein, 525 aa, Trichodesmium erythraeum IMS101
KVLVSDSIDQNGINILSQVAQVDIKIGLPVEELVKIIPEYDGLMIRSGTKVTKEIIEAADKLKIIGRAGVGVDNVDVQAATRKGIVVVNSPEGNTIAAAEHALAMMLSMSRHVPEANQSIINAQWDRKKFVGVEVYKKTLGVVGLGKIGSHVAKVAKAMGMKILAYDPFISEERAEQLGCSLVDLDLLVQESDYITLHIPKTDETYHSINAETFAKMKPTARIINCSRGGIIDEVALSKALKEGKIAGAALDVYENEPLEVESPLRDLGQKIVMTPHLGASTAEAQVNVAIDVAEQIRDVLLGLPARSAVNIPGMYPDTLKKLKPYLRLAETLGNLVSQLAGGRIDFLNVRLEGDLAGGDSKPVVVGALKGLLSQALRERVNYVNAFIEAKERGIRVVETRDDSVRDYTGSLHLEAKGSLGEHNVRGSLLGKDEIRITNIDGFPINVPPSPYMLLTLHRDMPGIIGKIGSLLGSFNVNIASMQVGRKIVRGDAVMVLSVDDPLPEEILTEILKEPGIRNAYTVAL

SEQ ID NO: 1382 - protein, 511 aa, uncultured methanogenic archaeon RC-I
KVLVTDPISEEGIKILKSEPGVQVDIETRLTKEQLIEKIKDYNALIIRSETQVTKEVIAAGKNLKIIGRAGVGIDNVDVPAATEKGIIVANAPEGNTIAACEHTLSMMLAMSRNIPQANASLKSGKWERSKFMGVEVMNKTLGIIGLGRIGGEITKRARSFGMEVLAYDPFTTAERAQQIGARLTTLDEIYEKADFITVHTPLTPSTKHMVSTAQFEKMKKGVRIINCARGGIIDEAALLEAIKSGKVAGAALDVFEKEPPVGSPLLEQPNIIVTPHLGASTAEAQINVAITIAEQVLNAFKGLPVTTAINIPIMKPEVMEKVKPFLPLAEQLGKFAAQITDGQIKEAIVSYNGEIAQKDVTLVTVAVLKGLLDVKLGEPVNYVNAKHIAKDRSINVAETKLAETGDYTNLITLTLKTDKGETRVSGTIFGKSDARIVEIQGYRVDAVPSGTMIVTRHQDRPGVIGKVGMILGKLNINISGMVVGRDAVRGDAVMILTVDDEVPAATLKQM

SEQ ID NO: 1383 - protein, 525 aa, Desulfotomaculum reducens MI-1
KVLVMDGVSEQGLAPLRQHTDIEVVIGEKMTEDQLVEVIGEYDAMIVRSATKVTPRVVEAAKKLKVIGRAGVGVDNIDRNAATNKGIVVVNAPDGNTIAAAEHTMAMMLGLARKVPAACGKLKNGIWDKKAFLGVELRGKTLGVIGLGRIGTAVAKRAQAMEMNIVAYDPYISEDHARKMAVEIVTLQELFKRADFITIHMPKTKETYHMINEEALELMKDGVRIINCARGGIVDEEALYKFMEAGKVAGAALDVFETEPCTDNPLLKLDNFIATPHLGASTQEAQINVAVDVAEEIVAALRGDLVKNAVNMPSMSPKLLAKIRPFLDLAEKLGTFQAQMLDGRIEKVEVVYSGELAKYDVNPVTTILLKGLLDPILQENVNFVNATLVARNRGISVVQTTKENGEDYHNLITVYIYTDKGRRMLSGTLFQGNDPRIVNIDGFRINAATQGHMLVVPHIDKPGIVGKVGTVVGDMAINIAGMQVGRIELGGKAIMVMMVDNTLPTNALEQLATIDGILEVKMVSL

SEQ ID NO: 1384 - protein, 518 aa, Lyngbya sp. PCC 8106
KVLVSDSIDPAGIDILSQVAQVDVKTGLPAEELVKIISEYDALMIRSGTRVTQEIIEAGVQLKIIGRAGVGVDNVDVAAATRAGIVVVNSPEGNTIAAAEHALAMMLSLSRYIPEANQSVKSGKWDRKKFIGVEVYKKTLGIVGLGKIGSHVAAAAKAMGMKLLAFDPYISQERADQLSCRLVDLELLLQESDYITLHMPKTKDTYHMIDAKAFEKMKPTARIINCARGGIIDEAALVEALKQGQIAGAAIDVYENEPLEAESPLRALDQKLVLTPHLGASTEEAQVNVAVDVAEQIRDVLLGLPARSAVNIPGLYPDALEKLKPYLQLAETLGNLVSQLAGGRVDFLDVRLQGELATNNSQPVVVASLKGLLSQALRERVNYVNASIEAKERGIHVIETRDASANDYTGSLHLEAKGSLGTHSVTGALLGSSEMRITNIDGFPINVPPTHHMLFTLHRDMPGIIGKIGSLLGSFNVNIASMQVGRKIVRGEAVMVLSIDDPLPEGLLSEIMKVPGIR

SEQ ID NO: 1385 - protein, 534 aa, Artificial
  Substituion in SEQ ID NO 1378
MVRENMATKILVTDDISQAGIDILSGLQGAEVVVRTNLAPDELKEAIADADALVVRSQTRVTRDVIESAKKLKVIGRAGVGVDNIDLEAATRRGILVINAPDGNTIAAAEHTFAMMISLARHIPAAHRDLLQGNWNRKKWIGVELRGKTLAVLGMGRIGTEVAKRAKAFGMTVLGYDPFLTEERAQSLGVKRCDLDTAIREADFITVHTPLTKETHHMIDAGRIAQMKEGVRIINCARGGIIDEVALAEALEAGRVAGAAIDVFEQEPLPMDHPLRRCPNVVLTPHLGASTVEAQENVAIQVAEEIVQVLRDDTFEHAVNLPSLSQRQKERLAPYLALAEQLGLFAAQLAQGAPSSMTVRYAGDAADPDGGYLTRTVLKGFFSFQYNGEVNYVNALRYAEDAGLRVQEVRESRGRVYTNDVEISVATDNGTHRVTGTVLGEYGPRIVELDGYPIDTPIQGILIYTRHEDRPGMIGRIGTLLGDRDINIAGMQVGRRETGGEAVMLLSVDKRVPQDVIDEIAKHPGIRLVRAIEL

SEQ ID NO: 1386 - protein, 534 aa, Artificial
  Substituion in SEQ ID NO 1378
MVRENMATKILVTDDISQAGIDILSGLQGAEVVVRTNLAPDELKEAIADADALVVRSQTRVTRDVIESAKKLKVIGRAGVGVDNIDLEAATRRGILVINAPDGNTIAAAEHTFAMMISLARHIPAAHRDLLQGNWNRKKWIGVELRGKTLAVLGMGRIGTEVAKRAKAFGMTVLGYDPFLTEERAQSLGVKRCDLDTAIREADFITVHTPLTKETHHMIDAGRIAQMKEGVRIINCARGGIIDEVALAEALEAGRVAGAAIDVFEQEPLPMDHPLRRCPNVVLTPHLGASTVEAQENVAIQVAEEIVQVLRDDTFEHAVNLPSLSQRQKDRLAPYLALAEQLGLFAAQLAQGAPSSMTVRYAGDAADPDGGYLTRTVLKGFFSFQYNGEVNYVNALRYAEDAGLRVQEVRESRGRVYTNEVEISVATDNGTHRVTGTVLGEYGPRIVELDGYPIDTPIQGILIYTRHEDRPGMIGRIGTLLGDRDINIAGMQVGRRETGGEAVMLLSVDKRVPQDVIDEIAKHPGIRLVRAIEL

SEQ ID NO: 1387 - protein, 534 aa, Artificial
  Substituion in SEQ ID NO 1378
MVRENMATKILVTDDISQAGIDILSGLQGAEVVVRTNLAPDELKEAIADADALVVRSQTRVTRDVIESAKKLKVIGRAGVGVDNIDLEAATRRGILVINAPDGNTIAAAEHTFAMMISLARHIPAAHRDLLQGNWNRKKWIGVELRGKTLAVLGMGRIGTEVAKRAKAFGMTVLGYDPFLTEERAQSLGVKRCDLDTAIREADFITVHTPLTKETHHMIDAGRIAQMKEGVRIINCARGGIIDEVALAEALEAGRVAGAAIDVFEQEPLPMDHPLRRCPNVVLTPHLGASTVEAQENVAIQVAEEIVQVLRDDTFEHAVNLPSLSQRQKERLAPYLALAEQLGLFAAQLAQGAPSSMTVRYAGDAADPDGGYLTRTVLKGFFSFQYNGEVNYVNALRYAEDAGLKVQEVRESRGRVYTNEVEISVATDNGTHRVTGTVLGEYGPRIVELDGYPIDTPIQGILIYTRHEDRPGMIGRIGTLLGDRDINIAGMQVGRRETGGEAVMLLSVDKRVPQDVIDEIAKHPGIRLVRAIEL

SEQ ID NO: 1388 - protein, 534 aa, Artificial
  Substituion in SEQ ID NO 1378
MVRENMATKILVTDDISQAGIDILSGLQGAEVVVRTNLAPDELKEAIADADALVVRSQTRVTRDVIESAKKLKVIGRAGVGVDNIDLEAATRRGILVINAPDGNTIAAAEHTFAMMISLARHIPAAHRDLLQGNWNRKKWIGVELRGKTLAVLGMGRIGTEVAKRAKAFGMTVLGYDPFLTEERAQSLGVKRCDLDTAIREADFITVHTPLTKETHHMIDAGRIAQMKEGVRIINCARGGIIDEVALAEALEAGRVAGAAIDVFENEPLPMDHPLRRCPNVVLTPHLGASTVEAQENVAIQVAEEIVQVLRDDTFEHAVNLPSLSQRQKERLAPYLALAEQLGLFAAQLAQGAPSSMTVRYAGDAADPDGGYLTRTVLKGFFSFQYNGEVNYVNALRYAEDAGLRVQEVRESRGRVYTNEVEISVATDNGTHRVTGTVLGEYGPRIVELDGYPIDTPIQGILIYTRHEDRPGMIGRIGTLLGDRDINIAGMQVGRRETGGEAVMLLSVDKRVPQDVIDEIAKHPGIRLVRAIEL

SEQ ID NO: 1389 - protein, 534 aa, Artificial
  Substituion in SEQ ID NO 1378
MVRENMATKILVTDDISQAGIDILSGLQGAEVVVRTNLAPDELKEAIADADALVVRSQTRVTRDVIESAKKLKVIGRAGVGVDNIDLEAATRRGILVINAPDGNTIAAAEHTFAMMISLARHIPAAHRDLLQGNWNRKKWIGVELRGKTLAVLGMGRIGTEVAKRAKAFGMTVLGYDPFLTEERAQSLGVKRCDLDTAIREADFITVHTPLTKETHHMIDAGRIAQMKEGVRIINCARGGIIDEVALAEALEAGRVAGAAIDVFEQEPLPMDHPLRRCPNVVLTPHLGASTVEAQENVAIQVAEEIVQVLRDDTFEHAVNLPSLSQRQKERLAPYLALAEQLGLFAAQLAQGAPSSMTVRYAGDAADPDGGYLTRTVLKGFFSFQYNGEVNYVNALRYAEDAGLRVQEVRESRGRVYTNEVEISVATDNGTHRVTGTVLGEYGPRIVELDGYPIDTPIQGILIYTRHEDRPGMIGRIGTLLGDRDLNIAGMQVGRRETGGEAVMLLSVDKRVPQDVIDEIAKHPGIRLVRAIEL

SEQ ID NO: 1390 - DNA, 1605 bp, Artificial
  Substituion in SEQ ID NO 1379
gtggtgagagagaacatggcgaccaagattttggtgacggacgacatctcccaggcgggcatcgacatcctctccggccttcagggcgcggaggtcgtggtcaggacgaatctcgcgccggacgagctgaaggaggccattgccgacgcggacgcccttgtggtgcgctcgcagacgcgcgtgacgagggacgtgatcgagagcgcgaaaaagctcaaggtcatcggccgcgcgggcgtcggcgtcgacaacatcgatcttgaggcggccacgcgccgcggcatcctggtcatcaacgccccagatggcaacaccattgcggcggcggagcacaccttcgcgatgatgatcagccttgcgcggcacatccccgcggctcatcgggatctcctccagggcaactggaatcgcaagaagtggattggcgtcgagcttcgcggcaagacgctggcggtcctcggcatgggccgcatcggcacggaggtcgcgaagcgggcgaaggcgttcggcatgactgtcctcgggtatgatccgttcctgacggaggagcgcgcgcagagcctcggcgtcaagcggtgcgatctcgacaccgccatccgcgaggccgacttcatcaccgtgcacacgccgctgacgaaagagacgcatcacatgattgatgccggccggatcgcccagatgaaggagggcgtgcggatcatcaactgcgcgcgcggcggcatcatcgacgaggtggcgctcgcggaggcgctcgaggcggggcgcgtggcgggcgccgccatcgacgtgtttgagcaggagccgctgccgatggatcacccgctcaggcgctgcccgaacgtcgtgttgacgccgcacctcggcgcgtcgacggtggaggcgcaggagaacgtggcgattcaagtggcggaggaaatcgtgcaggtgcttcgcgacgacaccttcgagcacgcggtcaacctgccgagcctgagccagcgccagaaggagcggctcgcgccttatctcgcccttgcggagcaactggggctgtttgcggcgcagctcgcgcagggcgcgccctcgagcatgaccgtgcgctacgccggtgacgcggccgatccagacggcggctacctcacccgcacggtgctgaagggcttcttcagcttccagtacaacggcgaggtcaactacgtcaacgcgctgcggtacgcggaagacgcgggcctgcgtgtgcaggaggtgcgcgagtcgcgcggccgggtgtacacgaacgatgtggagatctcggtcgcgacggacaacggcacgcaccgcgtgacgggcacggtcctcggggagtacgggccgcgcatcgtcgagctcgacgggtaccccattgacacgcccattcaaggcatcctcatctacacgcggcacgaggaccgtcccggcatgatcggccgcatcggcacgctacttggcgatcgcgacatcaacattgccggcatgcaggtgggccggcgggagacgggcggagaagcggtgatgctcctgtccgtcgacaagcgcgtgccgcaggacgtgatcgacgaaatcgcgaagcatccgggcattcgactggtcagggccatcgagctgtga

SEQ ID NO: 1391 - DNA, 1605 bp, Artificial
  Substituion in SEQ ID NO 1379
gtggtgagagagaacatggcgaccaagattttggtgacggacgacatctcccaggcgggcatcgacatcctctccggccttcagggcgcggaggtcgtggtcaggacgaatctcgcgccggacgagctgaaggaggccattgccgacgcggacgcccttgtggtgcgctcgcagacgcgcgtgacgagggacgtgatcgagagcgcgaaaaagctcaaggtcatcggccgcgcgggcgtcggcgtcgacaacatcgatcttgaggcggccacgcgccgcggcatcctggtcatcaacgccccagatggcaacaccattgcggcggcggagcacaccttcgcgatgatgatcagccttgcgcggcacatccccgcggctcatcgggatctcctccagggcaactggaatcgcaagaagtggattggcgtcgagcttcgcggcaagacgctggcggtcctcggcatgggccgcatcggcacggaggtcgcgaagcgggcgaaggcgttcggcatgactgtcctcgggtatgatccgttcctgacggaggagcgcgcgcagagcctcggcgtcaagcggtgcgatctcgacaccgccatccgcgaggccgacttcatcaccgtgcacacgccgctgacgaaagagacgcatcacatgattgatgccggccggatcgcccagatgaaggagggcgtgcggatcatcaactgcgcgcgcggcggcatcatcgacgaggtggcgctcgcggaggcgctcgaggcggggcgcgtggcgggcgccgccatcgacgtgtttgagcaggagccgctgccgatggatcacccgctcaggcgctgcccgaacgtcgtgttgacgccgcacctcggcgcgtcgacggtggaggcgcaggagaacgtggcgattcaagtggcggaggaaatcgtgcaggtgcttcgcgacgacaccttcgagcacgcggtcaacctgccgagcctgagccagcgccagaaggatcggctcgcgccttatctcgcccttgcggagcaactggggctgtttgcggcgcagctcgcgcagggcgcgccctcgagcatgaccgtgcgctacgccggtgacgcggccgatccagacggcggctacctcacccgcacggtgctgaagggcttcttcagcttccagtacaacggcgaggtcaactacgtcaacgcgctgcggtacgcggaagacgcgggcctgcgtgtgcaggaggtgcgcgagtcgcgcggccgggtgtacacgaacgaggtggagatctcggtcgcgacggacaacggcacgcaccgcgtgacgggcacggtcctcggggagtacgggccgcgcatcgtcgagctcgacgggtaccccattgacacgcccattcaaggcatcctcatctacacgcggcacgaggaccgtcccggcatgatcggccgcatcggcacgctacttggcgatcgcgacatcaacattgccggcatgcaggtgggccggcgggagacgggcggagaagcggtgatgctcctgtccgtcgacaagcgcgtgccgcaggacgtgatcgacgaaatcgcgaagcatccgggcattcgactggtcagggccatcgagctgtga

SEQ ID NO: 1392 - DNA, 1605 bp, Artificial
  Substituion in SEQ ID NO 1379
gtggtgagagagaacatggcgaccaagattttggtgacggacgacatctcccaggcgggcatcgacatcctctccggccttcagggcgcggaggtcgtggtcaggacgaatctcgcgccggacgagctgaaggaggccattgccgacgcggacgcccttgtggtgcgctcgcagacgcgcgtgacgagggacgtgatcgagagcgcgaaaaagctcaaggtcatcggccgcgcgggcgtcggcgtcgacaacatcgatcttgaggcggccacgcgccgcggcatcctggtcatcaacgccccagatggcaacaccattgcggcggcggagcacaccttcgcgatgatgatcagccttgcgcggcacatccccgcggctcatcgggatctcctccagggcaactggaatcgcaagaagtggattggcgtcgagcttcgcggcaagacgctggcggtcctcggcatgggccgcatcggcacggaggtcgcgaagcgggcgaaggcgttcggcatgactgtcctcgggtatgatccgttcctgacggaggagcgcgcgcagagcctcggcgtcaagcggtgcgatctcgacaccgccatccgcgaggccgacttcatcaccgtgcacacgccgctgacgaaagagacgcatcacatgattgatgccggccggatcgcccagatgaaggagggcgtgcggatcatcaactgcgcgcgcggcggcatcatcgacgaggtggcgctcgcggaggcgctcgaggcggggcgcgtggcgggcgccgccatcgacgtgtttgagcaggagccgctgccgatggatcacccgctcaggcgctgcccgaacgtcgtgttgacgccgcacctcggcgcgtcgacggtggaggcgcaggagaacgtggcgattcaagtggcggaggaaatcgtgcaggtgcttcgcgacgacaccttcgagcacgcggtcaacctgccgagcctgagccagcgccagaaggagcggctcgcgccttatctcgcccttgcggagcaactggggctgtttgcggcgcagctcgcgcagggcgcgccctcgagcatgaccgtgcgctacgccggtgacgcggccgatccagacggcggctacctcacccgcacggtgctgaagggcttcttcagcttccagtacaacggcgaggtcaactacgtcaacgcgctgcggtacgcggaagacgcgggcctgaaagtgcaggaggtgcgcgagtcgcgcggccgggtgtacacgaacgaggtggagatctcggtcgcgacggacaacggcacgcaccgcgtgacgggcacggtcctcggggagtacgggccgcgcatcgtcgagctcgacgggtaccccattgacacgcccattcaaggcatcctcatctacacgcggcacgaggaccgtcccggcatgatcggccgcatcggcacgctacttggcgatcgcgacatcaacattgccggcatgcaggtgggccggcgggagacgggcggagaagcggtgatgctcctgtccgtcgacaagcgcgtgccgcaggacgtgatcgacgaaatcgcgaagcatccgggcattcgactggtcagggccatcgagctgtga

SEQ ID NO: 1393 - DNA, 1605 bp, Artificial
  Substituion in SEQ ID NO 1379
gtggtgagagagaacatggcgaccaagattttggtgacggacgacatctcccaggcgggcatcgacatcctctccggccttcagggcgcggaggtcgtggtcaggacgaatctcgcgccggacgagctgaaggaggccattgccgacgcggacgcccttgtggtgcgctcgcagacgcgcgtgacgagggacgtgatcgagagcgcgaaaaagctcaaggtcatcggccgcgcgggcgtcggcgtcgacaacatcgatcttgaggcggccacgcgccgcggcatcctggtcatcaacgccccagatggcaacaccattgcggcggcggagcacaccttcgcgatgatgatcagccttgcgcggcacatccccgcggctcatcgggatctcctccagggcaactggaatcgcaagaagtggattggcgtcgagcttcgcggcaagacgctggcggtcctcggcatgggccgcatcggcacggaggtcgcgaagcgggcgaaggcgttcggcatgactgtcctcgggtatgatccgttcctgacggaggagcgcgcgcagagcctcggcgtcaagcggtgcgatctcgacaccgccatccgcgaggccgacttcatcaccgtgcacacgccgctgacgaaagagacgcatcacatgattgatgccggccggatcgcccagatgaaggagggcgtgcggatcatcaactgcgcgcgcggcggcatcatcgacgaggtggcgctcgcggaggcgctcgaggcggggcgcgtggcgggcgccgccatcgacgtgtttgagaatgagccgctgccgatggatcacccgctcaggcgctgcccgaacgtcgtgttgacgccgcacctcggcgcgtcgacggtggaggcgcaggagaacgtggcgattcaagtggcggaggaaatcgtgcaggtgcttcgcgacgacaccttcgagcacgcggtcaacctgccgagcctgagccagcgccagaaggagcggctcgcgccttatctcgcccttgcggagcaactggggctgtttgcggcgcagctcgcgcagggcgcgccctcgagcatgaccgtgcgctacgccggtgacgcggccgatccagacggcggctacctcacccgcacggtgctgaagggcttcttcagcttccagtacaacggcgaggtcaactacgtcaacgcgctgcggtacgcggaagacgcgggcctgcgtgtgcaggaggtgcgcgagtcgcgcggccgggtgtacacgaacgaggtggagatctcggtcgcgacggacaacggcacgcaccgcgtgacgggcacggtcctcggggagtacgggccgcgcatcgtcgagctcgacgggtaccccattgacacgcccattcaaggcatcctcatctacacgcggcacgaggaccgtcccggcatgatcggccgcatcggcacgctacttggcgatcgcgacatcaacattgccggcatgcaggtgggccggcgggagacgggcggagaagcggtgatgctcctgtccgtcgacaagcgcgtgccgcaggacgtgatcgacgaaatcgcgaagcatccgggcattcgactggtcagggccatcgagctgtga

SEQ ID NO: 1394 - DNA, 1605 bp, Artificial
  Substituion in SEQ ID NO 1379
gtggtgagagagaacatggcgaccaagattttggtgacggacgacatctcccaggcgggcatcgacatcctctccggccttcagggcgcggaggtcgtggtcaggacgaatctcgcgccggacgagctgaaggaggccattgccgacgcggacgcccttgtggtgcgctcgcagacgcgcgtgacgagggacgtgatcgagagcgcgaaaaagctcaaggtcatcggccgcgcgggcgtcggcgtcgacaacatcgatcttgaggcggccacgcgccgcggcatcctggtcatcaacgccccagatggcaacaccattgcggcggcggagcacaccttcgcgatgatgatcagccttgcgcggcacatccccgcggctcatcgggatctcctccagggcaactggaatcgcaagaagtggattggcgtcgagcttcgcggcaagacgctggcggtcctcggcatgggccgcatcggcacggaggtcgcgaagcgggcgaaggcgttcggcatgactgtcctcgggtatgatccgttcctgacggaggagcgcgcgcagagcctcggcgtcaagcggtgcgatctcgacaccgccatccgcgaggccgacttcatcaccgtgcacacgccgctgacgaaagagacgcatcacatgattgatgccggccggatcgcccagatgaaggagggcgtgcggatcatcaactgcgcgcgcggcggcatcatcgacgaggtggcgctcgcggaggcgctcgaggcggggcgcgtggcgggcgccgccatcgacgtgtttgagcaggagccgctgccgatggatcacccgctcaggcgctgcccgaacgtcgtgttgacgccgcacctcggcgcgtcgacggtggaggcgcaggagaacgtggcgattcaagtggcggaggaaatcgtgcaggtgcttcgcgacgacaccttcgagcacgcggtcaacctgccgagcctgagccagcgccagaaggagcggctcgcgccttatctcgcccttgcggagcaactggggctgtttgcggcgcagctcgcgcagggcgcgccctcgagcatgaccgtgcgctacgccggtgacgcggccgatccagacggcggctacctcacccgcacggtgctgaagggcttcttcagcttccagtacaacggcgaggtcaactacgtcaacgcgctgcggtacgcggaagacgcgggcctgcgtgtgcaggaggtgcgcgagtcgcgcggccgggtgtacacgaacgaggtggagatctcggtcgcgacggacaacggcacgcaccgcgtgacgggcacggtcctcggggagtacgggccgcgcatcgtcgagctcgacgggtaccccattgacacgcccattcaaggcatcctcatctacacgcggcacgaggaccgtcccggcatgatcggccgcatcggcacgctacttggcgatcgcgacttaaacattgccggcatgcaggtgggccggcgggagacgggcggagaagcggtgatgctcctgtccgtcgacaagcgcgtgccgcaggacgtgatcgacgaaatcgcgaagcatccgggcattcgactggtcagggccatcgagctgtga

SEQ ID NO: 1395 - protein, 312 aa, Alicyclobacillus acidocaldarius
MTIRLTRIVIIGVGSVGTATAYTLYLRERASEVVLIDADMQKAEGEALDMQHGSIYCGGTKIRAGTYEDCATADIVIVTAGVAQRPGQSRIDLLVKNIQVIQDISFKLKQYGFNGILIVASNPVDILSYVAWYISGLPSERVIGSGTVLDSLRFRYYLGRELGVDPGSVHAQVLGEHGDTQVHIWSSLNVGGVQVPISERIRGVEDHTRRAAYELIEHKGYTNYGIALVLDAICEAILQDKHTVLTVSTKVAEYHGVSDVYLSVPCVIGVRGIERVIEVPMSDMEERVFQESAKHLYNATREAIRIIGWRES

SEQ ID NO: 1396 - DNA, 939 bp, Alicyclobacillus acidocaldarius
atgacaatacgattgactcggattgtgataattggagtgggttctgtaggaacagccactgcttacacactatatttacgggaacgagcatcagaagtcgtcttaattgatgcggatatgcaaaaagcggaaggcgaagctctagatatgcaacacggtagtatttattgcggtgggacgaaaatccgcgcgggtacatatgaggactgtgcaacagcagacatcgtaattgtcacggctggagtggctcagaggcctggacaatcacgtattgacctcttggtgaagaatatacaagttattcaggatatttcttttaaactaaaacaatatggttttaatggaattctcattgttgcatccaatcccgtagatatacttagctatgtcgcatggtatatttcgggcttgccatctgaacgggtaataggatcagggactgtcttggattcgctcaggttccgatattaccttggtagagaattgggggtcgatcctgggagtgtccatgcacaggtgctaggcgaacatggtgacacgcaagttcacatatggagtagtttgaatgttggtggagttcaggtgccaatatctgaaaggattaggggcgtcgaggaccatacgcgtcgagctgcttatgaattaattgaacacaaaggttacacaaattatggaatcgcattagtgctcgatgcaatctgcgaagctatattacaggacaaacatacggttttgactgtttcaacaaaagtagcagaatatcacggggtatcggatgtttatttgagtgttccgtgtgttataggggtgcgagggatcgaacgcgttatcgaagttcctatgagtgacatggaagagagggtgtttcaagaatctgcaaaacatctttataacgccacgagggaagccattcgtatcattgggtggagagagtcataa

SEQ ID NO: 1397 - protein, 300 aa, Clostridium tetani E88
KISIIGSGFVGSTTAYALMMEGLASEIVIVDINKEKAKGEAMDLSHGVSFVKPVDIIAGDYEDTKDSDIVIITAGAGPKPGETRLDLINKNYEIFKGIVPEVVKYSPKSILLVVSNPVDILTYVTYKLSGFPQERVIGSGTVLDTSRFRYLLGEHFKIDVRNVHTYILGEHGDSEIAAWSLTNIAGISVEDYCKDICKGCEGNFKNRIPEEVKNAAYEVLERKGYTSYAIALAVRRIVEAIIRDEDSILTVSTLLRGEYGINDIYMGIPSVIGETGIKRVLEVKLSKDEEKQLKESAEVL

SEQ ID NO: 1398 - protein, 300 aa, L-lactate dehydrogenase (L-LDH) Score: 270 Significance: 9e-71 Identities: 137/300 Positives: 201/300 Gaps: 10 /300; identical to SEQ ID NO: 1397

SEQ ID NO: 1399 - protein, 300 aa, Acidobacteria bacterium Ellin345
RIAVVGLGNVGASFAFALLQRRLAAEIVLIDANHKKAEGEAMDLNHAVPFGAATRIWAGEYADCRGAAVTVITAGAAQRPGETRLQLLDRNLAIFQQIVPEVVKHNPDGLLLIATNPVDIISYASYKISGLPAHRVLGSGTILDTARFRYLLGQHFSVDARSVHGLILGEHGDTEVPIWSLANIAGIRLREYCRLHSLPYDEHVFDTIFTDTRDAAYKIIERKGATYYAVAVGLMQIVESIVRDQKTVLTTSTLVEGAYGINDVYLSLPTIVGAKGVVQVLTPDLSEEELAKLQHSAEVL

SEQ ID NO: 1400 - protein, 303 aa, Chloroflexus aggregans DSM 9485
RTGKVGVVGTGMVGTSFAYALMQRSLASELVLIDIDRARAEGEAMDLNHGLPFVRPMRIYAGDYADLADADLIVIAAGANQRPGETRLDLLGRNAAIFRDMIPAILAANHDGIIVVATNPVDILTTIAAQIAGSDANRVIGSGTILDTARFRYLLGQHYGVDPRSVHAYIVGEHGDSELALWSLANIAGVRLVDFVGANGQGYDQAALDAILEQTRNAAYEIIKRKRATYYAIGLGLLAIAEAVLRDQHTVMTVSSLMTGQYGVTDIAISLPTIVGRDGAEEVLNLPLSDHEVALFQRSANLL

SEQ ID NO: 1401 - protein, 302 aa, Desulfovibrio vulgaris subsp. vulgaris str. Hildenborough
MNRIAVIGVGNVGMAFAYAAAIKRLANDIVLIDANAARAEGESMDLADAMALVGPVQIRSGGYEQCEGARIVVVTAGAKQMPGQSRLDLVRVNAGITRDILTAVMQYADDPLYIMATNPVDVLTHVARTVTGVAPGRVIGSGTVLDSARFRGHVAEILGVDVRGVHAHIVGEHGDSEVALWSRANVSGIPVAEMCARRGIAYDAAFREKALGHVRHAAYEIIGRKGATGYGIGMSLCRIVEAILHDEHSVLTVSCPVAGHYGLGDVSLSLPCVIGSDGIEEVLDAPIAEDEQAALAASARVL

SEQ ID NO: 1402 - protein, 312 aa, Artificial
  Substituion in SEQ ID NO 1395
MTIRLTRIVIIGVGSVGTATAYTLYLRERASEVVLIDADMQKAEGEALDMQHGSIYCGGTKIRAGTYEDCATADIVIVTAGVAQRPGQSRIDLLVKNIQVIQDISFKLKQYGFNGILIVASNPVDILSYVAWYISGLPSERVIGSGTVLDSLRFRYYLGRELGVDPGSVHAQVLGEHGDTQVHIWSSLNVGGVQVPISERIRGVEDHTRRAAYELIEHKGYTNYGIALVLDAICEAILQDKHTVLTVSTKVAEYHGVSDVYLSVPCVIGVRGIDRVIEVPMSDMEERVFQESAKHLYNATREAIRIIGWRES

SEQ ID NO: 1403 - protein, 312 aa, Artificial
  Substituion in SEQ ID NO 1395
MTIRLTRIVIIGVGSVGTATAYTLYLRERASEVVLIDADMQKAEGEALDMQHGSIYCGGTKIRAGTYEDCATADIVIVTAGVAQRPGQSRIDLLVKNIQVIQDISFKLKQYGFNGILIVASNPVDILSYVAWYISGLPSERVIGSGTVLDSLRFRYYLGRELGVDPGSVHAQVLGEHGDTQVHIWSSLNVGGVQVPISERIRGVEDHTRRAAYELIEHKGYTNYGIALVLDAICEAILQDKHTVLTVSTKVAEYHGVSDVYLSVPCVIGVRGIERVIEVPMSDMEERVFQESAKHLYNATREAIRLIGWRES

SEQ ID NO: 1404 - protein, 312 aa, Artificial
  Substituion in SEQ ID NO 1395
MTIRLTRIVIIGVGSVGTATAYTLYLRERASEVVLIDADMQKAEGEALDMQHGSIYCGGTKIRAGTYEDCATADIVIVTAGVAQRPGQSRIDLLVKNIQVIQDISFKLKQYGFNGILIVASNPVDILSYVAWYISGLPSERVIGSGTVLDSLRFRYYLGRELGVDPGSVHAQVLGEHGDTQVHIWSSLNVGGVQVPISERIRGVEDHTRRAAYELIEHKGYTNYGIALVLDAICEAILQDKHTVLTVSTKVAEYHGVSDVYLSVPCVIGVRGIERVIDVPMSDMEERVFQESAKHLYNATREAIRIIGWRES

SEQ ID NO: 1405 - protein, 312 aa, Artificial
  Substituion in SEQ ID NO 1395
MTIRLTRIVIIGVGSVGTATAYTLYLRERASEVVLIDADMQKAEGEALDMQHGSIYCGGTKIRAGTYEDCATADIVIVTAGVAQRPGQSRIDLLVKNIQVIQDISFRLKQYGFNGILIVASNPVDILSYVAWYISGLPSERVIGSGTVLDSLRFRYYLGRELGVDPGSVHAQVLGEHGDTQVHIWSSLNVGGVQVPISERIRGVEDHTRRAAYELIEHKGYTNYGIALVLDAICEAILQDKHTVLTVSTKVAEYHGVSDVYLSVPCVIGVRGIERVIEVPMSDMEERVFQESAKHLYNATREAIRIIGWRES

SEQ ID NO: 1406 - protein, 312 aa, Artificial
  Substituion in SEQ ID NO 1395
MTIRLTRIVIIGVGSVGTATAYTLYLRERASEVVLIDADMQKAEGEALDMQHGSIYCGGTKIRAGTYEDCATADIVIVTAGVAQRPGQSRIDLLVKNIQVLQDISFKLKQYGFNGILIVASNPVDILSYVAWYISGLPSERVIGSGTVLDSLRFRYYLGRELGVDPGSVHAQVLGEHGDTQVHIWSSLNVGGVQVPISERIRGVEDHTRRAAYELIEHKGYTNYGIALVLDAICEAILQDKHTVLTVSTKVAEYHGVSDVYLSVPCVIGVRGIERVIEVPMSDMEERVFQESAKHLYNATREAIRIIGWRES

SEQ ID NO: 1407 - DNA, 939 bp, Artificial
  Substituion in SEQ ID NO 1396
atgacaatacgattgactcggattgtgataattggagtgggttctgtaggaacagccactgcttacacactatatttacgggaacgagcatcagaagtcgtcttaattgatgcggatatgcaaaaagcggaaggcgaagctctagatatgcaacacggtagtatttattgcggtgggacgaaaatccgcgcgggtacatatgaggactgtgcaacagcagacatcgtaattgtcacggctggagtggctcagaggcctggacaatcacgtattgacctcttggtgaagaatatacaagttattcaggatatttcttttaaactaaaacaatatggttttaatggaattctcattgttgcatccaatcccgtagatatacttagctatgtcgcatggtatatttcgggcttgccatctgaacgggtaataggatcagggactgtcttggattcgctcaggttccgatattaccttggtagagaattgggggtcgatcctgggagtgtccatgcacaggtgctaggcgaacatggtgacacgcaagttcacatatggagtagtttgaatgttggtggagttcaggtgccaatatctgaaaggattaggggcgtcgaggaccatacgcgtcgagctgcttatgaattaattgaacacaaaggttacacaaattatggaatcgcattagtgctcgatgcaatctgcgaagctatattacaggacaaacatacggttttgactgtttcaacaaaagtagcagaatatcacggggtatcggatgtttatttgagtgttccgtgtgttataggggtgcgagggatcgatcgcgttatcgaagttcctatgagtgacatggaagagagggtgtttcaagaatctgcaaaacatctttataacgccacgagggaagccattcgtatcattgggtggagagagtcataa

SEQ ID NO: 1408 - DNA, 939 bp, Artificial
  Substituion in SEQ ID NO 1396
atgacaatacgattgactcggattgtgataattggagtgggttctgtaggaacagccactgcttacacactatatttacgggaacgagcatcagaagtcgtcttaattgatgcggatatgcaaaaagcggaaggcgaagctctagatatgcaacacggtagtatttattgcggtgggacgaaaatccgcgcgggtacatatgaggactgtgcaacagcagacatcgtaattgtcacggctggagtggctcagaggcctggacaatcacgtattgacctcttggtgaagaatatacaagttattcaggatatttcttttaaactaaaacaatatggttttaatggaattctcattgttgcatccaatcccgtagatatacttagctatgtcgcatggtatatttcgggcttgccatctgaacgggtaataggatcagggactgtcttggattcgctcaggttccgatattaccttggtagagaattgggggtcgatcctgggagtgtccatgcacaggtgctaggcgaacatggtgacacgcaagttcacatatggagtagtttgaatgttggtggagttcaggtgccaatatctgaaaggattaggggcgtcgaggaccatacgcgtcgagctgcttatgaattaattgaacacaaaggttacacaaattatggaatcgcattagtgctcgatgcaatctgcgaagctatattacaggacaaacatacggttttgactgtttcaacaaaagtagcagaatatcacggggtatcggatgtttatttgagtgttccgtgtgttataggggtgcgagggatcgaacgcgttatcgaagttcctatgagtgacatggaagagagggtgtttcaagaatctgcaaaacatctttataacgccacgagggaagccattcgtttaattgggtggagagagtcataa

SEQ ID NO: 1409 - DNA, 939 bp, Artificial
  Substituion in SEQ ID NO 1396
atgacaatacgattgactcggattgtgataattggagtgggttctgtaggaacagccactgcttacacactatatttacgggaacgagcatcagaagtcgtcttaattgatgcggatatgcaaaaagcggaaggcgaagctctagatatgcaacacggtagtatttattgcggtgggacgaaaatccgcgcgggtacatatgaggactgtgcaacagcagacatcgtaattgtcacggctggagtggctcagaggcctggacaatcacgtattgacctcttggtgaagaatatacaagttattcaggatatttcttttaaactaaaacaatatggttttaatggaattctcattgttgcatccaatcccgtagatatacttagctatgtcgcatggtatatttcgggcttgccatctgaacgggtaataggatcagggactgtcttggattcgctcaggttccgatattaccttggtagagaattgggggtcgatcctgggagtgtccatgcacaggtgctaggcgaacatggtgacacgcaagttcacatatggagtagtttgaatgttggtggagttcaggtgccaatatctgaaaggattaggggcgtcgaggaccatacgcgtcgagctgcttatgaattaattgaacacaaaggttacacaaattatggaatcgcattagtgctcgatgcaatctgcgaagctatattacaggacaaacatacggttttgactgtttcaacaaaagtagcagaatatcacggggtatcggatgtttatttgagtgttccgtgtgttataggggtgcgagggatcgaacgcgttatcgatgttcctatgagtgacatggaagagagggtgtttcaagaatctgcaaaacatctttataacgccacgagggaagccattcgtatcattgggtggagagagtcataa

SEQ ID NO: 1410 - DNA, 939 bp, Artificial
  Substituion in SEQ ID NO 1396
atgacaatacgattgactcggattgtgataattggagtgggttctgtaggaacagccactgcttacacactatatttacgggaacgagcatcagaagtcgtcttaattgatgcggatatgcaaaaagcggaaggcgaagctctagatatgcaacacggtagtatttattgcggtgggacgaaaatccgcgcgggtacatatgaggactgtgcaacagcagacatcgtaattgtcacggctggagtggctcagaggcctggacaatcacgtattgacctcttggtgaagaatatacaagttattcaggatatttcttttcgtctaaaacaatatggttttaatggaattctcattgttgcatccaatcccgtagatatacttagctatgtcgcatggtatatttcgggcttgccatctgaacgggtaataggatcagggactgtcttggattcgctcaggttccgatattaccttggtagagaattgggggtcgatcctgggagtgtccatgcacaggtgctaggcgaacatggtgacacgcaagttcacatatggagtagtttgaatgttggtggagttcaggtgccaatatctgaaaggattaggggcgtcgaggaccatacgcgtcgagctgcttatgaattaattgaacacaaaggttacacaaattatggaatcgcattagtgctcgatgcaatctgcgaagctatattacaggacaaacatacggttttgactgtttcaacaaaagtagcagaatatcacggggtatcggatgtttatttgagtgttccgtgtgttataggggtgcgagggatcgaacgcgttatcgaagttcctatgagtgacatggaagagagggtgtttcaagaatctgcaaaacatctttataacgccacgagggaagccattcgtatcattgggtggagagagtcataa

SEQ ID NO: 1411 - DNA, 939 bp, Artificial
  Substituion in SEQ ID NO 1396
atgacaatacgattgactcggattgtgataattggagtgggttctgtaggaacagccactgcttacacactatatttacgggaacgagcatcagaagtcgtcttaattgatgcggatatgcaaaaagcggaaggcgaagctctagatatgcaacacggtagtatttattgcggtgggacgaaaatccgcgcgggtacatatgaggactgtgcaacagcagacatcgtaattgtcacggctggagtggctcagaggcctggacaatcacgtattgacctcttggtgaagaatatacaagttttacaggatatttcttttaaactaaaacaatatggttttaatggaattctcattgttgcatccaatcccgtagatatacttagctatgtcgcatggtatatttcgggcttgccatctgaacgggtaataggatcagggactgtcttggattcgctcaggttccgatattaccttggtagagaattgggggtcgatcctgggagtgtccatgcacaggtgctaggcgaacatggtgacacgcaagttcacatatggagtagtttgaatgttggtggagttcaggtgccaatatctgaaaggattaggggcgtcgaggaccatacgcgtcgagctgcttatgaattaattgaacacaaaggttacacaaattatggaatcgcattagtgctcgatgcaatctgcgaagctatattacaggacaaacatacggttttgactgtttcaacaaaagtagcagaatatcacggggtatcggatgtttatttgagtgttccgtgtgttataggggtgcgagggatcgaacgcgttatcgaagttcctatgagtgacatggaagagagggtgtttcaagaatctgcaaaacatctttataacgccacgagggaagccattcgtatcattgggtggagagagtcataa

SEQ ID NO: 1412 - protein, 427 aa, Alicyclobacillus acidocaldarius
MTYFKTAAELEQHWKTDPRWKGVERAYTAEDVIRLRGSVHIEHTLAQMGAEKLWRGLHEDGFIRALGALTGNQAVQQVKAGLKAIYVSGWQVAADANLAEHMYPDQSLYPSNSVPSLVRRINNALLRADQIQTAEGKGDIDWMVPIVADAEAGFGGPLNVFELMKMMIEAGAAGVHFEDQLSSEKKCGHMGGKVLIPTSHAVRNLTAARLAADVLGVPTVIVARTDANGAFLITSDVDDRDARFITGERTPEGFYRFRGGLEAAIARGLAYAPYADMIWCETSEPNIEEAKRFAEAIKAEFPDKLLAYNCSPSFNWRKKLDPKTIEEFQEIIASFGYKFQFVTLAGFHALNYSMFELAYGYNQRGMGAYSDLQQQEFAAEARGYTATRHQREVGTGYFDEVAQVVSGGLSSTTALTGSTEEEQFVEA

SEQ ID NO: 1413 - DNA, 1284 bp, Alicyclobacillus acidocaldarius
atgacatacttcaaaacggcggcggaactggagcagcattggaagacggatcctcgttggaaaggcgtcgagcgcgcctatacggccgaagacgtgattcggctcaggggatcggtgcacattgaacacacactcgcgcagatgggcgcggagaagctgtggcggggtctccatgaagacggcttcattcgcgcgctcggtgccctgaccggcaaccaggccgtgcaacaggtgaaagcggggctgaaggccatctacgtcagcggctggcaggtggcggcggacgccaacctggctgagcatatgtacccggatcagagcctgtatccgtccaacagcgtgccgagcctcgtgcggcgcatcaacaacgcgctgttgcgcgcggatcagattcagaccgcggaaggcaagggcgacatcgactggatggtgccgattgtggccgacgccgaggcaggcttcggcgggccgctgaacgtgttcgaactcatgaagatgatgattgaggccggcgccgcgggcgttcacttcgaagatcagctgtcatcggagaagaagtgcggtcacatgggcggcaaggtgctcatccccacgtcgcacgcggtgcggaatctgacggccgcccgtctcgctgccgatgtgctcggcgtgccgacggtcatcgtggcgcgcacagacgccaacggcgcgttcctcatcacgagcgatgtcgacgatcgcgacgcgcggttcatcaccggcgagcgcacgccggaagggttctaccggttccggggcgggctggaggccgcaattgcccgcggactcgcttatgcgccgtacgcggacatgatctggtgcgagacgtccgagccgaacatcgaggaagcgaagcggtttgcggaggccatcaaggccgaattcccggataaacttctggcctacaactgctcgccctctttcaactggcggaagaagctcgatccgaagaccatcgaggagttccaggagatcatcgcgtcgttcggctacaagttccagttcgtgaccctggcgggcttccacgccctcaactacagcatgttcgagctcgcgtatggctacaaccagcgcggcatgggggcgtactcggacctgcagcagcaggagttcgcggcggaggcccgtggctacacggcgacacgccatcagcgggaggtgggcacgggctacttcgatgaagtggcgcaggtggtgtcgggcgggctctcgtccacgacggcgctcaccggctccacggaggaggagcagtttgtggaggcgtga

SEQ ID NO: 1414 - protein, 404 aa, Geobacillus thermodenitrificans NG80-2
SFAERVRQLEESWKNEERWKGVVRPYSAEDVIKLRGSLDIEHTLARRGAEKLWKLLNTEDYVHALGALTGNQAVQQVKAGLKAIYLSGWQVAADANLAGHMYPDQSLYPSNSVPHVVKRINQALQRADQIQYLEGSGDVDYFVPIVADAEAGFGGQLNVFELMKAMIEAGAAGVHFEDQLSSEKKCGHLGGKVLLPTQTAVRNLIAARLAADVMGVPTVLIARTDANAADLITSDIDPRDQQFITGERTTEGFYRTRAGLDQAIARGLAYAPYADLIWCETSEPNLDEARRFAEAIHEQFPGKLLAYNCSPSFNWKKKLDDETIAKFQQELGKMGYKFQFVTLAGFHALNYSMFELARGYKDRGMAAYAELQQAEFAAEKYGYTATRHQREVGTGYFDEVAQVI

SEQ ID NO: 1415 - protein, 404 aa, Geobacillus kaustophilus HTA426
SFAERVRQLEESWKNEERWKGIVRPYSAEDVIKLRGSLDIEYTLARRGAEKLWKLLHTEDYVAALGALTGNQAVQQVKAGLKAIYLSGWQVAADANLAGQMYPDQSLYPSNSVPHVVKRINQALQRADQIQYLEGSGDVDYFVPIVADAEAGFGGQLNVFELMKAMIEAGAAGVHFEDQLSSEKKCGHLGGKVLLPTQTAIRNLIAARLAADVMGVPTVLIARTDANAADLITSDIDPRDQAFITGERTPEGFYRTRAGLDQAIARGLAYAPYADLIWCETSEPNLDEARRFAEAIHEKFPGKLLAYNCSPSFNWKKKLDDETIAKFQQELGKMGYKFQFVTLAGFHALNYSMFELARGYKERGMAAYAELQQAEFAAEKYGYTATRHQREVGTGYFDEVAQVI

SEQ ID NO: 1416 - protein, 397 aa, Bacillus cereus ATCC 10987
KLQESWELDTRWKGITRPYSAEDVIRLRGSIDIEHTLARRGAEKLWASLHTEDYINALGALTGNQAMQQVKAGLKAIYLSGWQVAADANLSGHMYPDQSLYPANSVPAVVKRINQTLQRADQIQHMEGSGDTDYFVPIVADAEAGFGGQLNVFELMKGMIEAGASGVHFEDQLSSEKKCGHLGGKVLLPTQTAVRNLISARLAADVMGVPTIIVARTDADAADLITSDIDPVDKAFITGERTPEGFYRTKAGLDQAIARGLAYAPYADLVWCETSEPNLEDAKRFAEAIHKEHPGKLLAYNCSPSFNWKQKLDEKTIASFQKEIASYGYKFQFVTLAGFHSLNYGMFELARGYKERGMAAYSELQQAEFAAEKHGYSATRHQREVGTGYFDEVAQVI

SEQ ID NO: 1417 - protein, 397 aa, Bacillus thuringiensis str. Al Hakam
KLQESWELDTRWKGITRPYSAEDVIRLRGSIDIEHTLARRGAEKLWASLHTEDYINALGALTGNQAMQQVKAGLKAIYLSGWQVAADANLSGHMYPDQSLYPANSVPAVVKRINQTLQRADQIQHMEGSGDTDYFVPIVADAEAGFGGQLNVFELMKGMIEAGASGVHFEDQLSSEKKCGHLGGKVLLPTQTAVRNLISARLAADVMGVPTIIVARTDADAADLITSDIDPVDKAFITGERTPEGFYRTKAGLDQAIARGLAYAPYADLVWCETSEPNLEDAKRFADAIHKEHPGKLLAYNCSPSFNWKQKLDEKTIASFQKEIASYGYKFQFVTLAGFHSLNYGMFELARGYKERGMAAYSELQQAEFAAEKHGYSATRHQREVGTGYFDEVAQVI

SEQ ID NO: 1418 - protein, 397 aa, Bacillus anthracis str. Ames; identical to SEQ ID NO: 1417

SEQ ID NO: 1419 - protein, 427 aa, Artificial
  Substituion in SEQ ID NO 1412
MTYFKTAAELEQHWKTDPRWKGVERAYTAEDVIRLRGSVHIEHTLAQMGAEKLWKGLHEDGFIRALGALTGNQAVQQVKAGLKAIYVSGWQVAADANLAEHMYPDQSLYPSNSVPSLVRRINNALLRADQIQTAEGKGDIDWMVPIVADAEAGFGGPLNVFELMKMMIEAGAAGVHFEDQLSSEKKCGHMGGKVLIPTSHAVRNLTAARLAADVLGVPTVIVARTDANGAFLITSDVDDRDARFITGERTPEGFYRFRGGLEAAIARGLAYAPYADMIWCETSEPNIEEAKRFAEAIKAEFPDKLLAYNCSPSFNWRKKLDPKTIEEFQEIIASFGYKFQFVTLAGFHALNYSMFELAYGYNQRGMGAYSDLQQQEFAAEARGYTATRHQREVGTGYFDEVAQVVSGGLSSTTALTGSTEEEQFVEA

SEQ ID NO: 1420 - protein, 427 aa, Artificial
  Substituion in SEQ ID NO 1412
MTYFKTAAELEQHWKTDPRWKGVERAYTAEDVIRLRGSVHIEHTLAQMGAEKLWRGLHEDGFIRALGALTGNQAVQQVKAGLKAIYVSGWQVAADANLAEHMYPDQSLYPSNSVPSLVRRINNALLRADQIQTAEGKGDIDWMVPIVADAEAGFGGPLNVFELMKMMIEAGAAGVHFEDQLSSEKKCGHMGGKVLIPTSHAVRNLTAARLAADVLGVPTVIVARTDANGAFLITSDVDDRDARFITGERTPEGFYRFRGGLEAAIARGLAYAPYADMIWCETSEPNIEEAKRFAEAIKAEFPDKLLAYNCSPSFNWRKKLDPKTIDEFQEIIASFGYKFQFVTLAGFHALNYSMFELAYGYNQRGMGAYSDLQQQEFAAEARGYTATRHQREVGTGYFDEVAQVVSGGLSSTTALTGSTEEEQFVEA

SEQ ID NO: 1421 - protein, 427 aa, Artificial
  Substituion in SEQ ID NO 1412
MTYFKTAAELEQHWKTDPRWKGVERAYTAEDVIRLRGSVHIEHTLAQMGAEKLWRGLHEDGFIKALGALTGNQAVQQVKAGLKAIYVSGWQVAADANLAEHMYPDQSLYPSNSVPSLVRRINNALLRADQIQTAEGKGDIDWMVPIVADAEAGFGGPLNVFELMKMMIEAGAAGVHFEDQLSSEKKCGHMGGKVLIPTSHAVRNLTAARLAADVLGVPTVIVARTDANGAFLITSDVDDRDARFITGERTPEGFYRFRGGLEAAIARGLAYAPYADMIWCETSEPNIEEAKRFAEAIKAEFPDKLLAYNCSPSFNWRKKLDPKTIEEFQEIIASFGYKFQFVTLAGFHALNYSMFELAYGYNQRGMGAYSDLQQQEFAAEARGYTATRHQREVGTGYFDEVAQVVSGGLSSTTALTGSTEEEQFVEA

SEQ ID NO: 1422 - protein, 427 aa, Artificial
  Substituion in SEQ ID NO 1412
MTYFKTAAELEQHWKTDPRWKGVERAYTAEDVIRLRGSVHIEHTLAQMGAEKLWRGLHEDGFIRALGALTGNQAVQQVKAGLKAIYVSGWQVAADANLAEHMYPDQSLYPSNSVPSLVRRINNALLRADQIQTAEGKGDIDWMVPIVADAEAGFGGPLNVFELMKMMIEAGAAGVHFEDQLSSEKKCGHMGGKVLIPTSHAVRNLTAARLAADVLGVPTVIVARTDANGAFLITSDVDDRDARFITGERTPEGFYRFRGGLEAAIARGLAYAPYADMIWCETSEPNIEEAKRFAEAIKAEFPDKLLAYNCSPSFNWRKKLDPKTIEEFQEIIASFGYKFQFVTLAGFHALNYSMFELAYGYNQRGMGAYSDLQQQEFAAEARGYTATRHQREVGTGYFDEVAQVVSGGISSTTALTGSTEEEQFVEA

SEQ ID NO: 1423 - protein, 427 aa, Artificial
  Substituion in SEQ ID NO 1412
MTYFKTAAELEQHWKTDPRWKGVERAYTAEDVIRLRGSVHIEHTLAQMGAEKLWRGLHEDGFIRALGALTGNQAVQQVKAGLKAIYVSGWQVAADANLAEHMYPDQSLYPSNSVPSLVRRINNALLRADQIQTAEGKGDIDWMVPIVADAEAGFGGPLNVFELMKMMIEAGAAGVHFEDQLSSEKKCGHMGGKVLIPTSHAVRNLTAARLAADVLGVPTVIVARTDANGAFLITSDVDERDARFITGERTPEGFYRFRGGLEAAIARGLAYAPYADMIWCETSEPNIEEAKRFAEAIKAEFPDKLLAYNCSPSFNWRKKLDPKTIEEFQEIIASFGYKFQFVTLAGFHALNYSMFELAYGYNQRGMGAYSDLQQQEFAAEARGYTATRHQREVGTGYFDEVAQVVSGGLSSTTALTGSTEEEQFVEA

SEQ ID NO: 1424 - DNA, 1284 bp, Artificial
  Substituion in SEQ ID NO 1413
atgacatacttcaaaacggcggcggaactggagcagcattggaagacggatcctcgttggaaaggcgtcgagcgcgcctatacggccgaagacgtgattcggctcaggggatcggtgcacattgaacacacactcgcgcagatgggcgcggagaagctgtggaaaggtctccatgaagacggcttcattcgcgcgctcggtgccctgaccggcaaccaggccgtgcaacaggtgaaagcggggctgaaggccatctacgtcagcggctggcaggtggcggcggacgccaacctggctgagcatatgtacccggatcagagcctgtatccgtccaacagcgtgccgagcctcgtgcggcgcatcaacaacgcgctgttgcgcgcggatcagattcagaccgcggaaggcaagggcgacatcgactggatggtgccgattgtggccgacgccgaggcaggcttcggcgggccgctgaacgtgttcgaactcatgaagatgatgattgaggccggcgccgcgggcgttcacttcgaagatcagctgtcatcggagaagaagtgcggtcacatgggcggcaaggtgctcatccccacgtcgcacgcggtgcggaatctgacggccgcccgtctcgctgccgatgtgctcggcgtgccgacggtcatcgtggcgcgcacagacgccaacggcgcgttcctcatcacgagcgatgtcgacgatcgcgacgcgcggttcatcaccggcgagcgcacgccggaagggttctaccggttccggggcgggctggaggccgcaattgcccgcggactcgcttatgcgccgtacgcggacatgatctggtgcgagacgtccgagccgaacatcgaggaagcgaagcggtttgcggaggccatcaaggccgaattcccggataaacttctggcctacaactgctcgccctctttcaactggcggaagaagctcgatccgaagaccatcgaggagttccaggagatcatcgcgtcgttcggctacaagttccagttcgtgaccctggcgggcttccacgccctcaactacagcatgttcgagctcgcgtatggctacaaccagcgcggcatgggggcgtactcggacctgcagcagcaggagttcgcggcggaggcccgtggctacacggcgacacgccatcagcgggaggtgggcacgggctacttcgatgaagtggcgcaggtggtgtcgggcgggctctcgtccacgacggcgctcaccggctccacggaggaggagcagtttgtggaggcgtga

SEQ ID NO: 1425 - DNA, 1284 bp, Artificial
  Substituion in SEQ ID NO 1413
atgacatacttcaaaacggcggcggaactggagcagcattggaagacggatcctcgttggaaaggcgtcgagcgcgcctatacggccgaagacgtgattcggctcaggggatcggtgcacattgaacacacactcgcgcagatgggcgcggagaagctgtggcggggtctccatgaagacggcttcattcgcgcgctcggtgccctgaccggcaaccaggccgtgcaacaggtgaaagcggggctgaaggccatctacgtcagcggctggcaggtggcggcggacgccaacctggctgagcatatgtacccggatcagagcctgtatccgtccaacagcgtgccgagcctcgtgcggcgcatcaacaacgcgctgttgcgcgcggatcagattcagaccgcggaaggcaagggcgacatcgactggatggtgccgattgtggccgacgccgaggcaggcttcggcgggccgctgaacgtgttcgaactcatgaagatgatgattgaggccggcgccgcgggcgttcacttcgaagatcagctgtcatcggagaagaagtgcggtcacatgggcggcaaggtgctcatccccacgtcgcacgcggtgcggaatctgacggccgcccgtctcgctgccgatgtgctcggcgtgccgacggtcatcgtggcgcgcacagacgccaacggcgcgttcctcatcacgagcgatgtcgacgatcgcgacgcgcggttcatcaccggcgagcgcacgccggaagggttctaccggttccggggcgggctggaggccgcaattgcccgcggactcgcttatgcgccgtacgcggacatgatctggtgcgagacgtccgagccgaacatcgaggaagcgaagcggtttgcggaggccatcaaggccgaattcccggataaacttctggcctacaactgctcgccctctttcaactggcggaagaagctcgatccgaagaccatcgatgagttccaggagatcatcgcgtcgttcggctacaagttccagttcgtgaccctggcgggcttccacgccctcaactacagcatgttcgagctcgcgtatggctacaaccagcgcggcatgggggcgtactcggacctgcagcagcaggagttcgcggcggaggcccgtggctacacggcgacacgccatcagcgggaggtgggcacgggctacttcgatgaagtggcgcaggtggtgtcgggcgggctctcgtccacgacggcgctcaccggctccacggaggaggagcagtttgtggaggcgtga

SEQ ID NO: 1426 - DNA, 1284 bp, Artificial
  Substituion in SEQ ID NO 1413
atgacatacttcaaaacggcggcggaactggagcagcattggaagacggatcctcgttggaaaggcgtcgagcgcgcctatacggccgaagacgtgattcggctcaggggatcggtgcacattgaacacacactcgcgcagatgggcgcggagaagctgtggcggggtctccatgaagacggcttcattaaagcgctcggtgccctgaccggcaaccaggccgtgcaacaggtgaaagcggggctgaaggccatctacgtcagcggctggcaggtggcggcggacgccaacctggctgagcatatgtacccggatcagagcctgtatccgtccaacagcgtgccgagcctcgtgcggcgcatcaacaacgcgctgttgcgcgcggatcagattcagaccgcggaaggcaagggcgacatcgactggatggtgccgattgtggccgacgccgaggcaggcttcggcgggccgctgaacgtgttcgaactcatgaagatgatgattgaggccggcgccgcgggcgttcacttcgaagatcagctgtcatcggagaagaagtgcggtcacatgggcggcaaggtgctcatccccacgtcgcacgcggtgcggaatctgacggccgcccgtctcgctgccgatgtgctcggcgtgccgacggtcatcgtggcgcgcacagacgccaacggcgcgttcctcatcacgagcgatgtcgacgatcgcgacgcgcggttcatcaccggcgagcgcacgccggaagggttctaccggttccggggcgggctggaggccgcaattgcccgcggactcgcttatgcgccgtacgcggacatgatctggtgcgagacgtccgagccgaacatcgaggaagcgaagcggtttgcggaggccatcaaggccgaattcccggataaacttctggcctacaactgctcgccctctttcaactggcggaagaagctcgatccgaagaccatcgaggagttccaggagatcatcgcgtcgttcggctacaagttccagttcgtgaccctggcgggcttccacgccctcaactacagcatgttcgagctcgcgtatggctacaaccagcgcggcatgggggcgtactcggacctgcagcagcaggagttcgcggcggaggcccgtggctacacggcgacacgccatcagcgggaggtgggcacgggctacttcgatgaagtggcgcaggtggtgtcgggcgggctctcgtccacgacggcgctcaccggctccacggaggaggagcagtttgtggaggcgtga

SEQ ID NO: 1427 - DNA, 1284 bp, Artificial
  Substituion in SEQ ID NO 1413
atgacatacttcaaaacggcggcggaactggagcagcattggaagacggatcctcgttggaaaggcgtcgagcgcgcctatacggccgaagacgtgattcggctcaggggatcggtgcacattgaacacacactcgcgcagatgggcgcggagaagctgtggcggggtctccatgaagacggcttcattcgcgcgctcggtgccctgaccggcaaccaggccgtgcaacaggtgaaagcggggctgaaggccatctacgtcagcggctggcaggtggcggcggacgccaacctggctgagcatatgtacccggatcagagcctgtatccgtccaacagcgtgccgagcctcgtgcggcgcatcaacaacgcgctgttgcgcgcggatcagattcagaccgcggaaggcaagggcgacatcgactggatggtgccgattgtggccgacgccgaggcaggcttcggcgggccgctgaacgtgttcgaactcatgaagatgatgattgaggccggcgccgcgggcgttcacttcgaagatcagctgtcatcggagaagaagtgcggtcacatgggcggcaaggtgctcatccccacgtcgcacgcggtgcggaatctgacggccgcccgtctcgctgccgatgtgctcggcgtgccgacggtcatcgtggcgcgcacagacgccaacggcgcgttcctcatcacgagcgatgtcgacgatcgcgacgcgcggttcatcaccggcgagcgcacgccggaagggttctaccggttccggggcgggctggaggccgcaattgcccgcggactcgcttatgcgccgtacgcggacatgatctggtgcgagacgtccgagccgaacatcgaggaagcgaagcggtttgcggaggccatcaaggccgaattcccggataaacttctggcctacaactgctcgccctctttcaactggcggaagaagctcgatccgaagaccatcgaggagttccaggagatcatcgcgtcgttcggctacaagttccagttcgtgaccctggcgggcttccacgccctcaactacagcatgttcgagctcgcgtatggctacaaccagcgcggcatgggggcgtactcggacctgcagcagcaggagttcgcggcggaggcccgtggctacacggcgacacgccatcagcgggaggtgggcacgggctacttcgatgaagtggcgcaggtggtgtcgggcgggatttcgtccacgacggcgctcaccggctccacggaggaggagcagtttgtggaggcgtga

SEQ ID NO: 1428 - DNA, 1284 bp, Artificial
  Substituion in SEQ ID NO 1413
atgacatacttcaaaacggcggcggaactggagcagcattggaagacggatcctcgttggaaaggcgtcgagcgcgcctatacggccgaagacgtgattcggctcaggggatcggtgcacattgaacacacactcgcgcagatgggcgcggagaagctgtggcggggtctccatgaagacggcttcattcgcgcgctcggtgccctgaccggcaaccaggccgtgcaacaggtgaaagcggggctgaaggccatctacgtcagcggctggcaggtggcggcggacgccaacctggctgagcatatgtacccggatcagagcctgtatccgtccaacagcgtgccgagcctcgtgcggcgcatcaacaacgcgctgttgcgcgcggatcagattcagaccgcggaaggcaagggcgacatcgactggatggtgccgattgtggccgacgccgaggcaggcttcggcgggccgctgaacgtgttcgaactcatgaagatgatgattgaggccggcgccgcgggcgttcacttcgaagatcagctgtcatcggagaagaagtgcggtcacatgggcggcaaggtgctcatccccacgtcgcacgcggtgcggaatctgacggccgcccgtctcgctgccgatgtgctcggcgtgccgacggtcatcgtggcgcgcacagacgccaacggcgcgttcctcatcacgagcgatgtcgacgaacgcgacgcgcggttcatcaccggcgagcgcacgccggaagggttctaccggttccggggcgggctggaggccgcaattgcccgcggactcgcttatgcgccgtacgcggacatgatctggtgcgagacgtccgagccgaacatcgaggaagcgaagcggtttgcggaggccatcaaggccgaattcccggataaacttctggcctacaactgctcgccctctttcaactggcggaagaagctcgatccgaagaccatcgaggagttccaggagatcatcgcgtcgttcggctacaagttccagttcgtgaccctggcgggcttccacgccctcaactacagcatgttcgagctcgcgtatggctacaaccagcgcggcatgggggcgtactcggacctgcagcagcaggagttcgcggcggaggcccgtggctacacggcgacacgccatcagcgggaggtgggcacgggctacttcgatgaagtggcgcaggtggtgtcgggcgggctctcgtccacgacggcgctcaccggctccacggaggaggagcagtttgtggaggcgtga

SEQ ID NO: 1429 - protein, 566 aa, Alicyclobacillus acidocaldarius
MDMNNVNKYTRQYFLPPEPCFDWVHKDHVDRPPIWCSVDLRDGNQALIVPMNLEEKLAYFQLLVEIGFKEIEVGFPAASDTEFEFVRTLIERDLVPSDVTIQVLTQSRDHIIERTFEAIRGAKRAIVHLYNSTSVAQREQVFRADKDEIVNIAVTGAEQIRDLARTTPGNFFFQYSPESFTGTELDFALEICNAVLDVWKPTPDRKVIINLPATVELSMPHVYASQIEYMGKRLARRDAIVLSVHPHNDRGTGVAAAELAMLAGAERLEGTLFGNGERTGNVDIVTLALNLYSHGIDPGLDFSNLPAIQARVEALTKMQVSRRHPYAGELVFTAFSGSHQDAIAKGMKWREEKSPEHWTVPYLPIDPKDIGREYEGDIIRINSQSGKGGIGYVLEQSHGFDLPPKMREQLGYAVKRVSDREQKELSADEIAEIFMREFVNLGQPLDLVELTGTDARGSHRVRATVVWQGETVEIEGAGNGRLDALCHALEEGLGIRVANLTYKEHALEVGSGSRAVAYISVDDEEGNTHFGCGVDTDIMEASAKALVSAVNRMLAHRAEMAVPVSK

SEQ ID NO: 1430 - DNA, 1701 bp, Alicyclobacillus acidocaldarius
atggacatgaacaacgtgaacaagtacacccgccagtattttctgccgcctgaaccctgcttcgactgggttcacaaggaccatgtggaccgaccgccgatctggtgcagcgtcgacctgcgcgacggaaatcaggcgctcatcgttccgatgaatctcgaggagaagcttgcgtactttcaactgctcgtcgagatcggcttcaaggagatcgaggtcggtttcccggccgcatcggacacggaattcgagttcgtccggacgctcatcgagcgcgatctcgtcccgagcgatgtgaccatccaggtcctcacgcaatcgcgcgatcacatcatcgaacgcacttttgaagccattcgcggggccaagcgggccatcgtccatctctacaactccacgtccgtggcgcagcgcgagcaggtgttccgcgcggacaaggacgagatcgtgaacattgccgtgaccggcgccgaacagatccgcgatctcgcccgcaccacgcccggcaacttcttcttccaatattcaccggagagcttcacgggtacggagctcgacttcgcgctcgagatctgcaacgcggtgctcgacgtgtggaaacccacgccggatcgcaaggtcatcatcaacctgccggcgaccgtcgagctttcgatgccgcacgtgtacgcgagccagatcgagtacatgggcaagcgcctggctcgccgcgatgccatcgtgctgtccgtgcatccgcacaacgatcgcggcacgggtgtcgcggcggctgaactcgccatgctcgcgggcgcggagcggctggagggcacgctgtttgggaacggggagcgcacgggcaacgtggacatcgtcacgctcgcgctgaacctgtactcgcacggcatcgatccggggctcgacttctccaacctcccggccatccaggcccgtgttgaggctctcaccaagatgcaggtgagcaggcgtcacccgtacgcgggggaactcgtcttcacggcgttttcgggatcgcatcaagacgcgatcgcgaagggcatgaagtggcgcgaggagaagtcgcctgagcattggacggtcccgtatctgcccatcgacccgaaggatattggccgcgaatacgagggggatatcatccgcatcaacagccagtctggcaagggcggcatcggctacgtgttggagcaatcgcacggcttcgatctgcctccaaagatgcgcgagcagctggggtatgcggtcaagcgggtgtcggatcgcgagcagaaggagctgtcggcggacgagatcgccgagatcttcatgcgcgagtttgtgaaccttgggcagccgctcgatctcgtcgaactgacgggcacggatgcgagagggtcgcaccgcgtgcgcgccacggtggtctggcagggcgagaccgtcgagatcgaaggggccggcaatgggcggttggacgcgctgtgccatgcgctggaggaggggctcgggatccgggtcgcgaatctcacgtacaaggaacatgcgctggaagtagggtcgggatcgcgagcggtggcttacatcagcgtcgacgacgaagaagggaatacccacttcgggtgcggcgtggataccgacattatggaggcgtcggcgaaggcgctggtgagcgcggtcaatcgaatgctggcgcacagggcggagatggcggtgcccgtgagcaaatga

SEQ ID NO: 1431 - protein, 549 aa, Clostridium leptum DSM 753
MRNVEKYTTQYFMPPVPCYDWTKKEYVEKAPIWCSVDLRDGNQALIVPMSLEEKLEFFKFLVEIGFKEIEVGFPAASETEYEFLRTLIERDMIPEDVTVQVLTQAREHIIRRTFEALEGCPRAIVHLYNSTSVAQREQVFRKSKEEIIRIAVDGAKLLQKISSEMGSDFRFEYSPESFTGTEMEFARDICNAVLDVWKPTPEKKVIINLPVTVEHSMPHVYACQVEYMCKHLDYRDSVVVSLHPHNDRGCGVADCELGLLAGADRIEGTLFGNGERTGNADIVTLALNMFSQGVDPKLNFEDMPSTVALYEKVTGMHVYDRQPYGGKLVFAAFSGSHQDAIAKGMKWREEKECDHWTVPYLCIDPKDIGREYEGDVIRINSQSGKGGIGYLLEQKYGFVLPPKMREDFGYAVKNVSDHQHKELQPEEVYEIFRREYLNINDKISLVDFHFVRNDCIHAAVTVKIGGVEKEIKGDGNGRLDAVSNAIKENLGIQYQDLTYTEHALEQGSKSRAAAYVGITGKDGRITWGVGVDSDIITASVKALFSAINR

SEQ ID NO: 1432 - protein, 555 aa, Desulfitobacterium hafniense Y51
MKNVDNYRRGYFMPPVKSLKWAEKEYITTPPTWCSVDLRDGNQALVVPMSLEEKLEYYHMLLKIGFKEIEVGFPAASETEYAFLRTLIEQNLIPEDVTIQVLTQSRDHIIEKTFKALVGVKKAVVHLYNSTSVAQREQVFKMSREEIVEIAVSGARLLKKYAAETEGNFQFEYSPESFTGTEMEFALEICNQVLDVFEPTPENKVIINLPATVSLSMPHVYASQIEYMSEHLKYRDNVILSLHPHNDRGTAVADAELGLLAGGQRIEGTLFGNGERTGNVDIVTLALNLFSHGVDPGLNFASMLEITAKYEALTRMKVHDRQPYGGKLVFAAFSGSHQDAITKGIKWREEHECHYWNVPYLLIDPQDIGREYEGDVIRINSQSGKGGIAYMLEQHYALDLPAKMREAFGYKVKNVSDNLHKELMPEEIKDIFFKEYVNIENPIKFLNFHFLNHDDFQTTVTLEFKGEIQELSGEGDGRLDAISNALQARLGLSYSNLIYKEHALELGSKSQAVSYVGVTGPDGVIHWGCGIHTDIFTSSVKALISAINTMIKDSA

SEQ ID NO: 1433 - protein, 550 aa, Ruminococcus obeum ATCC 29174
NMKNVTKYQRQYYMPPMKCMKWAEKEYVDKAPIWCSVDLRDGNQALVIPMSLEQKIEFFKLLVKIGFKEIEVGFPAASETEYTFVRTLIEQNLIPDDVTIQVLTQAREHIIRKTFEAVKGAPKAIVHVYNSTSVAQREQVFKKSKEEILKIAVDGAKLLKELADETEGNFQFEYSPESFTGTEPEYALEVCNAVLDVWQPTPENKAIINLPVTVELSMPHVYASQIEYMSENMKYRENVILSQHPHNDRGCGVADSELGLLAGADRVEGTLFGNGERTGNVDVVTLAMNMFAQGVDPELDFSDMPHICEVYEACTGMKVDERSPYSGALVFAAFSGSHQDAIAKGMHWRDEKDPNRWTVPYLPIDPTDVGRNYDADVIRINSQSGKGGVGYILETKYGLNLPPKMREAMGYAAKAVSDHCHKELHPDEIFNLFKSTFENVVEPYSIDEVHFQQKDGGITTQVTSTFNGKTITTEATGNGRLDAVSNALKKAYEMKFTLVTYQEHALEKSSSSKAIAYVGIQKPDGTLSWGAGVDPDIIRASIDALVTAIN

SEQ ID NO: 1434 - protein, 549 aa, Ruminococcus gnavus ATCC 29149
MKNFEKYERSYFMPPVPCYDWVKKDHIEKPPVWCSVDLRDGNQALIEPMSLEEKIEFFQMLLDVGFKQIEVGFPAASETEYQFLRTLIEQNMIPEDVTIQVLTQAREHIIKRTFEAVKGAPHAVIHLYNSTSVAQREQVFKKNKEEIKKIAVDGAILLNELAKETEGNFTFEYSPESFQGTEVDYALEVCNAVLRVWEPSRERKVIINLPTTVENAMPHVFASQVEYMSKHLYNREHVLLSLHPHNDRGSGVSDAELGILAGADRIEGTLFGNGERTGNVDIITVAMNMYSQGVDPGLDFSNMSEISETYERLTRMQVSPRQPYAGELVFTAFSGSHQDAIAKGMAWREEKQCQTWSVPYLPLDPKDVGRRYETDVIRINSQSGKGGVNYILKQSFGISLPQKMREEVGYLVKDVSDKAHKELTPDWVYHIFEDHYIHVKTIFTVDECHFKQEDGILAEATIHHAGSDRVINGMGNGRLDAVSNAIKHYFDIDYELAFYEEHSMTKGSSSKAVAYVGVICNKKRYWGVGIDADIIKASVEALVVAVNKI

SEQ ID NO: 1435 - protein, 551 aa, Clostridium sp. L2-50
LNMKNFEHYKRGYYMPPEKSVKWVEKEYIDKAPIWCSVDLRDGNQALIVPMNLDEKLEFFKELVRIGFKEIEIGFPAASETEYEFCRTLIEKNMIPDDVTIQVLTQARPHIIKKTFEAIDGAKHAIVHLYNSTSYAQRTQVFKKSKEEILQLAVDGAKLLNQMAEEHGVNYPFEYSPESFTGTEIDYALDVCNAVIKEWKPTPDRKVIINLPATVEMSLPHVYASQIEYMSEHLIDRENVILSLHPHNDRGCGVADAELGILAGADRIEGTLFGNGERTGNVDIITLAMNMFTHGVDPELDLSDIPKLTELYERVTNMHVYERSPYTGKLVFAAFSGSHQDAIAKGMKYRKDQGDGMWTVPYLPLNPEDIGRKYDGDVIRINSQSGKGGIGYILQSKYGFDLPPKFREDLGYTVKDVSDKAHKELSATEVLDIFQSTYVNIENPVRMLECHFVQGDGISTEITIMKYGEKKVYHGKGNGRLDAVSNAIKKHFDIDFKIICYEEHALQVGSNSQAVAYVGLEGKDGTVTWGAGIKDDIIDASVYALISAINR

SEQ ID NO: 1436 - protein, 566 aa, Artificial
  Substituion in SEQ ID NO 1429
MDMNNVNKYTRQYFLPPEPCFDWVHKDHVDRPPIWCSVDLRDGNQALIVPMNLEEKLAYFQLLVEIGFKEIEVGFPAASDTEFEFVRTLIERDLVPSDVTIQVLTQSRDHIIERTFEAIRGAKRAIVHLYNSTSVAQREQVFRADKDEIVNIAVTGAEQIRDLARTTPGNFFFQYSPESFTGTELDFALEICNAVLDVWKPTPDRKVIINLPATVELSMPHVYASQIEYMGKRLARRDAIVLSVHPHNDRGTGVAAAELAMLAGAERLEGTLFGNGERTGNVDIVTLALNLYSHGIDPGLDFSNLPAIQARVEALTKMQVSRRHPYAGELVFTAFSGSHQDAIAKGMKWREEKSPEHWTVPYLPIDPKDIGREYEGDIIRINSQSGKGGIGYVLEQSHGFDLPPKMREQLGYAVKRVSDREQKELSADEIAEIFMREFVNLGQPLDLVELTGTDARGSHKVRATVVWQGETVEIEGAGNGRLDALCHALEEGLGIRVANLTYKEHALEVGSGSRAVAYISVDDEEGNTHFGCGVDTDIMEASAKALVSAVNRMLAHRAEMAVPVSK

SEQ ID NO: 1437 - protein, 566 aa, Artificial
  Substituion in SEQ ID NO 1429
MDMNNVNKYTRQYFLPPEPCFDWVHKDHVDRPPIWCSVDLRDGNQALIVPMNLEEKLAYFQLLVEIGFKEIEVGFPAASDTEFEFVRTLIERDLVPSDVTIQVLTQSRDHIIERTFEAIRGAKRAIVHLYNSTSVAQREQVFRADKDEIVNIAVTGAEQIRDLARTTPGNFFFQYSPESFTGTELDFALEICNAVLDVWKPTPDRKVIINLPATVELSMPHVYASQIEYMGKRLARRDAIVLSVHPHNDRGTGVAAAELAMLAGAERLEGTLFGNGERTGNVDIVTLALNLYSHGIDPGLDFSNLPAIQARVEALTKMQVSRRHPYAGELVFTAFSGSHQDAIAKGMKWREEKSPEHWTVPYLPIDPKDIGREYEGDIIRINSQSGKGGIGYVLEQSHGFDLPPKMREQLGYAVKRVSDREQKELSADEIAEIFMREFVNLGQPLDLVELTGTDARGSHRVRATVVWQGETVEIEGAGNGRLDALCHALEEGLGIRVANITYKEHALEVGSGSRAVAYISVDDEEGNTHFGCGVDTDIMEASAKALVSAVNRMLAHRAEMAVPVSK

SEQ ID NO: 1438 - protein, 566 aa, Artificial
  Substituion in SEQ ID NO 1429
MDMNNVNKYTRQYFLPPEPCFDWVHKDHVDRPPIWCSVDLRDGNQALIVPMNLEEKLAYFQLLVEIGFKEIEVGFPAASDTEFEFVRTLIERDLVPSDVTIQVLTQSRDHIIERTFEAIRGAKRAIVHLYNSTSVAQREQVFRADKDEIVNIAVTGAEQIRDLARTTPGNFFFQYSPESFTGTEIDFALEICNAVLDVWKPTPDRKVIINLPATVELSMPHVYASQIEYMGKRLARRDAIVLSVHPHNDRGTGVAAAELAMLAGAERLEGTLFGNGERTGNVDIVTLALNLYSHGIDPGLDFSNLPAIQARVEALTKMQVSRRHPYAGELVFTAFSGSHQDAIAKGMKWREEKSPEHWTVPYLPIDPKDIGREYEGDIIRINSQSGKGGIGYVLEQSHGFDLPPKMREQLGYAVKRVSDREQKELSADEIAEIFMREFVNLGQPLDLVELTGTDARGSHRVRATVVWQGETVEIEGAGNGRLDALCHALEEGLGIRVANLTYKEHALEVGSGSRAVAYISVDDEEGNTHFGCGVDTDIMEASAKALVSAVNRMLAHRAEMAVPVSK

SEQ ID NO: 1439 - protein, 566 aa, Artificial
  Substituion in SEQ ID NO 1429
MDMNNVNKYTRQYFLPPEPCFDWVHKDHVDRPPIWCSVDLRDGNQALIVPMNLEEKLAYFQLLVEIGFKEIEVGFPAASDTEFEFVRTLIERDLVPSDVTIQVLTQSRDHIIERTFEAIRGAKRAIVHLYNSTSVAQRDQVFRADKDEIVNIAVTGAEQIRDLARTTPGNFFFQYSPESFTGTELDFALEICNAVLDVWKPTPDRKVIINLPATVELSMPHVYASQIEYMGKRLARRDAIVLSVHPHNDRGTGVAAAELAMLAGAERLEGTLFGNGERTGNVDIVTLALNLYSHGIDPGLDFSNLPAIQARVEALTKMQVSRRHPYAGELVFTAFSGSHQDAIAKGMKWREEKSPEHWTVPYLPIDPKDIGREYEGDIIRINSQSGKGGIGYVLEQSHGFDLPPKMREQLGYAVKRVSDREQKELSADEIAEIFMREFVNLGQPLDLVELTGTDARGSHRVRATVVWQGETVEIEGAGNGRLDALCHALEEGLGIRVANLTYKEHALEVGSGSRAVAYISVDDEEGNTHFGCGVDTDIMEASAKALVSAVNRMLAHRAEMAVPVSK

SEQ ID NO: 1440 - protein, 566 aa, Artificial
  Substituion in SEQ ID NO 1429
MDMNNVNKYTRQYFLPPEPCFDWVHKDHVDRPPIWCSVDLRDGNQALIVPMNLEEKLAYFQLLVEIGFKEIEVGFPAASDTEFEFVRTLIERDLVPSDVTIQVLTQSRDHIIERTFEAIRGAKRAIVHLYNSTSVAQREQVFRADKDEIVNIAVTGAEQIRDLARTTPGNFFFQYSPESFTGTELDFALEICNAVLDVWKPTPDRKVIINLPATVELSMPHVYASQIEYMGKRLARRDAIVLSVHPHNDRGTGVAAAELAMLAGAERLEGTLFGNGERTGNVDIVTLALNLYSHGIDPGLDFSNLPAIQARVEALTKMQVSRRHPYAGELVFTAFSGSHQDAIAKGMKWREEKSPEHWTVPYLPIDPKDIGREYEGDIIRINSQSGKGGIGYVLEQSHGFDLPPKMREQLGYAVKRVSDREQKELSADEIAEIFMREFINLGQPLDLVELTGTDARGSHRVRATVVWQGETVEIEGAGNGRLDALCHALEEGLGIRVANLTYKEHALEVGSGSRAVAYISVDDEEGNTHFGCGVDTDIMEASAKALVSAVNRMLAHRAEMAVPVSK

SEQ ID NO: 1441 - DNA, 1701 bp, Artificial
  Substituion in SEQ ID NO 1430
atggacatgaacaacgtgaacaagtacacccgccagtattttctgccgcctgaaccctgcttcgactgggttcacaaggaccatgtggaccgaccgccgatctggtgcagcgtcgacctgcgcgacggaaatcaggcgctcatcgttccgatgaatctcgaggagaagcttgcgtactttcaactgctcgtcgagatcggcttcaaggagatcgaggtcggtttcccggccgcatcggacacggaattcgagttcgtccggacgctcatcgagcgcgatctcgtcccgagcgatgtgaccatccaggtcctcacgcaatcgcgcgatcacatcatcgaacgcacttttgaagccattcgcggggccaagcgggccatcgtccatctctacaactccacgtccgtggcgcagcgcgagcaggtgttccgcgcggacaaggacgagatcgtgaacattgccgtgaccggcgccgaacagatccgcgatctcgcccgcaccacgcccggcaacttcttcttccaatattcaccggagagcttcacgggtacggagctcgacttcgcgctcgagatctgcaacgcggtgctcgacgtgtggaaacccacgccggatcgcaaggtcatcatcaacctgccggcgaccgtcgagctttcgatgccgcacgtgtacgcgagccagatcgagtacatgggcaagcgcctggctcgccgcgatgccatcgtgctgtccgtgcatccgcacaacgatcgcggcacgggtgtcgcggcggctgaactcgccatgctcgcgggcgcggagcggctggagggcacgctgtttgggaacggggagcgcacgggcaacgtggacatcgtcacgctcgcgctgaacctgtactcgcacggcatcgatccggggctcgacttctccaacctcccggccatccaggcccgtgttgaggctctcaccaagatgcaggtgagcaggcgtcacccgtacgcgggggaactcgtcttcacggcgttttcgggatcgcatcaagacgcgatcgcgaagggcatgaagtggcgcgaggagaagtcgcctgagcattggacggtcccgtatctgcccatcgacccgaaggatattggccgcgaatacgagggggatatcatccgcatcaacagccagtctggcaagggcggcatcggctacgtgttggagcaatcgcacggcttcgatctgcctccaaagatgcgcgagcagctggggtatgcggtcaagcgggtgtcggatcgcgagcagaaggagctgtcggcggacgagatcgccgagatcttcatgcgcgagtttgtgaaccttgggcagccgctcgatctcgtcgaactgacgggcacggatgcgagagggtcgcacaaagtgcgcgccacggtggtctggcagggcgagaccgtcgagatcgaaggggccggcaatgggcggttggacgcgctgtgccatgcgctggaggaggggctcgggatccgggtcgcgaatctcacgtacaaggaacatgcgctggaagtagggtcgggatcgcgagcggtggcttacatcagcgtcgacgacgaagaagggaatacccacttcgggtgcggcgtggataccgacattatggaggcgtcggcgaaggcgctggtgagcgcggtcaatcgaatgctggcgcacagggcggagatggcggtgcccgtgagcaaatga

SEQ ID NO: 1442 - DNA, 1701 bp, Artificial
  Substituion in SEQ ID NO 1430
atggacatgaacaacgtgaacaagtacacccgccagtattttctgccgcctgaaccctgcttcgactgggttcacaaggaccatgtggaccgaccgccgatctggtgcagcgtcgacctgcgcgacggaaatcaggcgctcatcgttccgatgaatctcgaggagaagcttgcgtactttcaactgctcgtcgagatcggcttcaaggagatcgaggtcggtttcccggccgcatcggacacggaattcgagttcgtccggacgctcatcgagcgcgatctcgtcccgagcgatgtgaccatccaggtcctcacgcaatcgcgcgatcacatcatcgaacgcacttttgaagccattcgcggggccaagcgggccatcgtccatctctacaactccacgtccgtggcgcagcgcgagcaggtgttccgcgcggacaaggacgagatcgtgaacattgccgtgaccggcgccgaacagatccgcgatctcgcccgcaccacgcccggcaacttcttcttccaatattcaccggagagcttcacgggtacggagctcgacttcgcgctcgagatctgcaacgcggtgctcgacgtgtggaaacccacgccggatcgcaaggtcatcatcaacctgccggcgaccgtcgagctttcgatgccgcacgtgtacgcgagccagatcgagtacatgggcaagcgcctggctcgccgcgatgccatcgtgctgtccgtgcatccgcacaacgatcgcggcacgggtgtcgcggcggctgaactcgccatgctcgcgggcgcggagcggctggagggcacgctgtttgggaacggggagcgcacgggcaacgtggacatcgtcacgctcgcgctgaacctgtactcgcacggcatcgatccggggctcgacttctccaacctcccggccatccaggcccgtgttgaggctctcaccaagatgcaggtgagcaggcgtcacccgtacgcgggggaactcgtcttcacggcgttttcgggatcgcatcaagacgcgatcgcgaagggcatgaagtggcgcgaggagaagtcgcctgagcattggacggtcccgtatctgcccatcgacccgaaggatattggccgcgaatacgagggggatatcatccgcatcaacagccagtctggcaagggcggcatcggctacgtgttggagcaatcgcacggcttcgatctgcctccaaagatgcgcgagcagctggggtatgcggtcaagcgggtgtcggatcgcgagcagaaggagctgtcggcggacgagatcgccgagatcttcatgcgcgagtttgtgaaccttgggcagccgctcgatctcgtcgaactgacgggcacggatgcgagagggtcgcaccgcgtgcgcgccacggtggtctggcagggcgagaccgtcgagatcgaaggggccggcaatgggcggttggacgcgctgtgccatgcgctggaggaggggctcgggatccgggtcgcgaatattacgtacaaggaacatgcgctggaagtagggtcgggatcgcgagcggtggcttacatcagcgtcgacgacgaagaagggaatacccacttcgggtgcggcgtggataccgacattatggaggcgtcggcgaaggcgctggtgagcgcggtcaatcgaatgctggcgcacagggcggagatggcggtgcccgtgagcaaatga

SEQ ID NO: 1443 - DNA, 1701 bp, Artificial
  Substituion in SEQ ID NO 1430
atggacatgaacaacgtgaacaagtacacccgccagtattttctgccgcctgaaccctgcttcgactgggttcacaaggaccatgtggaccgaccgccgatctggtgcagcgtcgacctgcgcgacggaaatcaggcgctcatcgttccgatgaatctcgaggagaagcttgcgtactttcaactgctcgtcgagatcggcttcaaggagatcgaggtcggtttcccggccgcatcggacacggaattcgagttcgtccggacgctcatcgagcgcgatctcgtcccgagcgatgtgaccatccaggtcctcacgcaatcgcgcgatcacatcatcgaacgcacttttgaagccattcgcggggccaagcgggccatcgtccatctctacaactccacgtccgtggcgcagcgcgagcaggtgttccgcgcggacaaggacgagatcgtgaacattgccgtgaccggcgccgaacagatccgcgatctcgcccgcaccacgcccggcaacttcttcttccaatattcaccggagagcttcacgggtacggagattgacttcgcgctcgagatctgcaacgcggtgctcgacgtgtggaaacccacgccggatcgcaaggtcatcatcaacctgccggcgaccgtcgagctttcgatgccgcacgtgtacgcgagccagatcgagtacatgggcaagcgcctggctcgccgcgatgccatcgtgctgtccgtgcatccgcacaacgatcgcggcacgggtgtcgcggcggctgaactcgccatgctcgcgggcgcggagcggctggagggcacgctgtttgggaacggggagcgcacgggcaacgtggacatcgtcacgctcgcgctgaacctgtactcgcacggcatcgatccggggctcgacttctccaacctcccggccatccaggcccgtgttgaggctctcaccaagatgcaggtgagcaggcgtcacccgtacgcgggggaactcgtcttcacggcgttttcgggatcgcatcaagacgcgatcgcgaagggcatgaagtggcgcgaggagaagtcgcctgagcattggacggtcccgtatctgcccatcgacccgaaggatattggccgcgaatacgagggggatatcatccgcatcaacagccagtctggcaagggcggcatcggctacgtgttggagcaatcgcacggcttcgatctgcctccaaagatgcgcgagcagctggggtatgcggtcaagcgggtgtcggatcgcgagcagaaggagctgtcggcggacgagatcgccgagatcttcatgcgcgagtttgtgaaccttgggcagccgctcgatctcgtcgaactgacgggcacggatgcgagagggtcgcaccgcgtgcgcgccacggtggtctggcagggcgagaccgtcgagatcgaaggggccggcaatgggcggttggacgcgctgtgccatgcgctggaggaggggctcgggatccgggtcgcgaatctcacgtacaaggaacatgcgctggaagtagggtcgggatcgcgagcggtggcttacatcagcgtcgacgacgaagaagggaatacccacttcgggtgcggcgtggataccgacattatggaggcgtcggcgaaggcgctggtgagcgcggtcaatcgaatgctggcgcacagggcggagatggcggtgcccgtgagcaaatga

SEQ ID NO: 1444 - DNA, 1701 bp, Artificial
  Substituion in SEQ ID NO 1430
atggacatgaacaacgtgaacaagtacacccgccagtattttctgccgcctgaaccctgcttcgactgggttcacaaggaccatgtggaccgaccgccgatctggtgcagcgtcgacctgcgcgacggaaatcaggcgctcatcgttccgatgaatctcgaggagaagcttgcgtactttcaactgctcgtcgagatcggcttcaaggagatcgaggtcggtttcccggccgcatcggacacggaattcgagttcgtccggacgctcatcgagcgcgatctcgtcccgagcgatgtgaccatccaggtcctcacgcaatcgcgcgatcacatcatcgaacgcacttttgaagccattcgcggggccaagcgggccatcgtccatctctacaactccacgtccgtggcgcagcgcgatcaggtgttccgcgcggacaaggacgagatcgtgaacattgccgtgaccggcgccgaacagatccgcgatctcgcccgcaccacgcccggcaacttcttcttccaatattcaccggagagcttcacgggtacggagctcgacttcgcgctcgagatctgcaacgcggtgctcgacgtgtggaaacccacgccggatcgcaaggtcatcatcaacctgccggcgaccgtcgagctttcgatgccgcacgtgtacgcgagccagatcgagtacatgggcaagcgcctggctcgccgcgatgccatcgtgctgtccgtgcatccgcacaacgatcgcggcacgggtgtcgcggcggctgaactcgccatgctcgcgggcgcggagcggctggagggcacgctgtttgggaacggggagcgcacgggcaacgtggacatcgtcacgctcgcgctgaacctgtactcgcacggcatcgatccggggctcgacttctccaacctcccggccatccaggcccgtgttgaggctctcaccaagatgcaggtgagcaggcgtcacccgtacgcgggggaactcgtcttcacggcgttttcgggatcgcatcaagacgcgatcgcgaagggcatgaagtggcgcgaggagaagtcgcctgagcattggacggtcccgtatctgcccatcgacccgaaggatattggccgcgaatacgagggggatatcatccgcatcaacagccagtctggcaagggcggcatcggctacgtgttggagcaatcgcacggcttcgatctgcctccaaagatgcgcgagcagctggggtatgcggtcaagcgggtgtcggatcgcgagcagaaggagctgtcggcggacgagatcgccgagatcttcatgcgcgagtttgtgaaccttgggcagccgctcgatctcgtcgaactgacgggcacggatgcgagagggtcgcaccgcgtgcgcgccacggtggtctggcagggcgagaccgtcgagatcgaaggggccggcaatgggcggttggacgcgctgtgccatgcgctggaggaggggctcgggatccgggtcgcgaatctcacgtacaaggaacatgcgctggaagtagggtcgggatcgcgagcggtggcttacatcagcgtcgacgacgaagaagggaatacccacttcgggtgcggcgtggataccgacattatggaggcgtcggcgaaggcgctggtgagcgcggtcaatcgaatgctggcgcacagggcggagatggcggtgcccgtgagcaaatga

SEQ ID NO: 1445 - DNA, 1701 bp, Artificial
  Substituion in SEQ ID NO 1430
atggacatgaacaacgtgaacaagtacacccgccagtattttctgccgcctgaaccctgcttcgactgggttcacaaggaccatgtggaccgaccgccgatctggtgcagcgtcgacctgcgcgacggaaatcaggcgctcatcgttccgatgaatctcgaggagaagcttgcgtactttcaactgctcgtcgagatcggcttcaaggagatcgaggtcggtttcccggccgcatcggacacggaattcgagttcgtccggacgctcatcgagcgcgatctcgtcccgagcgatgtgaccatccaggtcctcacgcaatcgcgcgatcacatcatcgaacgcacttttgaagccattcgcggggccaagcgggccatcgtccatctctacaactccacgtccgtggcgcagcgcgagcaggtgttccgcgcggacaaggacgagatcgtgaacattgccgtgaccggcgccgaacagatccgcgatctcgcccgcaccacgcccggcaacttcttcttccaatattcaccggagagcttcacgggtacggagctcgacttcgcgctcgagatctgcaacgcggtgctcgacgtgtggaaacccacgccggatcgcaaggtcatcatcaacctgccggcgaccgtcgagctttcgatgccgcacgtgtacgcgagccagatcgagtacatgggcaagcgcctggctcgccgcgatgccatcgtgctgtccgtgcatccgcacaacgatcgcggcacgggtgtcgcggcggctgaactcgccatgctcgcgggcgcggagcggctggagggcacgctgtttgggaacggggagcgcacgggcaacgtggacatcgtcacgctcgcgctgaacctgtactcgcacggcatcgatccggggctcgacttctccaacctcccggccatccaggcccgtgttgaggctctcaccaagatgcaggtgagcaggcgtcacccgtacgcgggggaactcgtcttcacggcgttttcgggatcgcatcaagacgcgatcgcgaagggcatgaagtggcgcgaggagaagtcgcctgagcattggacggtcccgtatctgcccatcgacccgaaggatattggccgcgaatacgagggggatatcatccgcatcaacagccagtctggcaagggcggcatcggctacgtgttggagcaatcgcacggcttcgatctgcctccaaagatgcgcgagcagctggggtatgcggtcaagcgggtgtcggatcgcgagcagaaggagctgtcggcggacgagatcgccgagatcttcatgcgcgagtttattaaccttgggcagccgctcgatctcgtcgaactgacgggcacggatgcgagagggtcgcaccgcgtgcgcgccacggtggtctggcagggcgagaccgtcgagatcgaaggggccggcaatgggcggttggacgcgctgtgccatgcgctggaggaggggctcgggatccgggtcgcgaatctcacgtacaaggaacatgcgctggaagtagggtcgggatcgcgagcggtggcttacatcagcgtcgacgacgaagaagggaatacccacttcgggtgcggcgtggataccgacattatggaggcgtcggcgaaggcgctggtgagcgcggtcaatcgaatgctggcgcacagggcggagatggcggtgcccgtgagcaaatga

SEQ ID NO: 1446 - protein, 441 aa, Alicyclobacillus acidocaldarius
MSRFPVCVFIVSTGQDVVKRAAKFYPDRWHKVGRRHGNVCPVFLCAVSVGGQRRTDIVNIHEYQAKAILAEFGVKVPRGKVAFTVEEAVEAAKELGGKAVVKAQIHAGGRGKAGGVKVSKSLEEVEANARELLGKRLVTHQTGPQGRIVRRLLIEELTNIQKEYYIGLVLDRSQGRLVMMASQEGGVEIEEVAAKHPEKIFRETIDPLTGLTPFQANNLAYKLELPQDAVKKAAQFMMALYNAYVAKDCSIAEINPLVLTAEGDIIALDAKLNFDDNALYRHPEIVSLRDEDEEDPKEIEASKYGLSYIALDGNIGCMVNGAGLAMATMDTIKYYGGEPANFLDVGGGASEEKVTAAFKIILSDPKVKGILVNIFGGIMKCDVIANGVVAAAKQVGLDKPLVVRLEGTNVEAGKKILNESGLKLVAADSLADAAQKIVALV

SEQ ID NO: 1447 - DNA, 1326 bp, Alicyclobacillus acidocaldarius
ttgtcaaggtttcctgtatgcgttttcatcgtctcaaccggtcaagacgttgtcaaacgtgccgcgaagttctatcctgatagatggcacaaggtcggcagacgccatggcaacgtttgtccggtttttttgtgcgccgtatccgtagggggacaaaggaggacggacatcgtgaacatccacgagtatcaagcgaaggccattctggctgaattcggcgtcaaagtcccgcgcggcaaagtggctttcacggttgaagaggctgtggaagcggcaaaagaacttggtggcaaggctgtagtaaaggctcaaattcatgcaggcgggcgcggcaaggcgggtggcgtcaaagtctcgaagtccctggaggaggtcgaggcgaacgcccgcgagcttctcggcaagcggctcgtcacgcaccaaacgggaccgcagggccgaattgtacggcgactgctcatcgaagagctcacgaatatccagaaggagtactacataggcctcgttcttgaccgatcccagggacgcttggtgatgatggcctcccaggagggcggcgtcgagatcgaagaggtagctgcaaaacacccggaaaagattttccgtgagaccattgatccactgacggggctcacgccgttccaggcgaacaacctcgcgtacaagcttgagctgcctcaggatgcggtgaaaaaggccgctcaattcatgatggcgctttacaacgcgtacgtcgcgaaggattgctccatcgcggagatcaatccgctggtactgacagcggaaggcgacatcatcgccctggatgcgaagctcaacttcgacgacaatgctttgtaccggcatcccgagatcgtcagcctgcgcgacgaggacgaagaagatccgaaggaaatcgaagcctcgaaatacggtttgagttacatcgcgctggacggcaacattggatgcatggtgaatggtgcgggcctggccatggccacgatggacaccatcaagtattacggcggagagcctgcgaacttcctggacgtcggtggaggcgccagcgaagagaaagtgacggcggcgttcaaaatcatcctgtcggatcctaaagtgaaaggtatcctcgtcaacatcttcggcggcatcatgaagtgcgacgtgatcgcaaacggcgtggtcgcagcggccaagcaggtcggcctggacaagccgctcgtggtgcgcctcgagggcacgaacgtcgaagccggaaagaaaatcttgaacgaatcgggtctgaagttggtggcggctgattcgctcgctgacgctgcccaaaagatcgtggcgctggtctga

SEQ ID NO: 1448 - protein, 385 aa, Geobacillus thermodenitrificans NG80-2
MNIHEYQAKEILRSYGVSVPNGRVAFTVDEAVEAAKALGTSVCVVKAQIHAGGRGKAGGVKVAKSLEEVRTYASELLGKVLVTHQTGPEGKEVKRLLIEEGCDIQKEYYIGLVVDRATSRVVLMGSEEGGTEIEEVAAKTPEKIFKEYVDPAVGLQAFQARRLAFNINIPKKLVNQAVKFMMGLYQVFVDKDCSIAEINPLVVTGDGKVMALDAKLNFDSNALYRHPDIMEYRDLDEEDPKEVEASKYDLNYIALDGNIGCMVNGAGLAMATMDIIKYYGGEPANFLDVGGGASEEKVTEAFKIILSDPNVKGIFVNIFGGIMKCDVIASGIVAATKQVGLTLPLVVRLEGTNVELGKKILQESGLNITAAESMADGAQKIVELV

SEQ ID NO: 1449 - protein, 385 aa, Geobacillus kaustophilus HTA426
MNIHEYQAKEILRSYGVSVPNGRVAFTVDEAVEAAKELGAPVCVVKAQIHAGGRGKAGGVKVAKSLEEVRTYASELLGKVLVTHQTGPEGKEVKRLLIEEGCDIQKEYYIGLVVDRATSRVVLMGSEEGGTEIEEVAAKTPEKIFKEYIDPAVGLQAFQARRLAFNINIPKHLVNQAVKFMMGLYQVFVDKDCSIAEINPLVVTGDGKVMALDAKLNFDSNALYRHPDILEYRDLDEEDPKEVEASKYDLNYIALDGNIGCMVNGAGLAMATMDIIKYYGGEPANFLDVGGGASEEKVREAFKIILSDPNVKGIFVNIFGGIMKCDVIASGIVAATKQVGLTLPLVVRLEGTNVELGKKILQESGLNIIAAESMADGAQKIVELV

SEQ ID NO: 1450 - protein, 385 aa, Bacillus sp. NRRL B-14911
MNIHEYQGKEVLRKYGVTVPNGKVAFTVEEAVEAAKELGTEVVVVKAQIHAGGRGKAGGVKVAKNLDEVRTYASEILGKTLVTHQTGPEGKEVKRLLIEEGCDIQKEYYVGLVLDRATSRVVLMASEEGGTEIEEVAEKTPEKIFKEEIDPVIGLTAFQARRIAFNINIPGKLVNQAAKFMLALYNAYIEKDCSIAEINPLVVTGDGKVMALDAKLNFDSNALYRQKDILEYRDLEEEDPKEIEASKYDLSYISLDGNIGCMVNGAGLAMATMDIVKHYGGDPANFLDVGGGATAEKVTEAFKIILSDPNVKGIFVNIFGGIMKCDVIAEGVVEAAKQVGLKVPLVVRLEGTNVDLGKKILAESDIDIIAADSMSDGAEKIVSLV

SEQ ID NO: 1451 - protein, 385 aa, Oceanobacillus iheyensis HTE831
MNIHEYQGKQVLREYGVKVPNGYVAYTVDEAVQAAEKLGTSVNVVKAQIHAGGRGKAGGVKVAKSLDEVRTYADEILGKTLVTHQTGPEGKEVKRLLIEEGCDIQKEYYVGVVLDRATSRVVMMASEEGGTEIEEVAEATPEKIFKEVIDPVVGLTPFQARRLAFNINIPEDLLGKAVKFMSGLYDAFVAKDCSIAEINPLVTTGDGEVLALDAKLNFDDNALYRHKDIQDLRDFEEEDEKEIQASKYDLSYVSLDGNIGCMVNGAGLAMSTMDIIKHYGGDPANFLDVGGGATAEKVTEAFKIILSDKNVKGIFVNIFGGIMKCDVIAEGVVEATKQIGLEIPLVVRLEGTNVDAGKKILDESGLNITTATSMADGAEKIVAAV

SEQ ID NO: 1452 - protein, 385 aa, Bacillus cereus subsp. cytotoxis NVH 391-98
MNIHEYQGKAILRSYGVSVPNGKVAFTVEEAVEAAKELGTDVCVVKAQIHAGGRGKAGGVKVAKNLEEVRTYAENILGSTLVTHQTGPEGKEVKRLLIEEGCDIKKEYYVGLVLDRATSQVVLMASEEGGTEIEEVAEKTPEKIFKEYIDPAVGLQGFQARRIAFHINIPKELVGQAVKFMMGLYRVFIEKDCSIAEINPLVTTGDGKVMALDAKLNFDSNALYRHKDILELRDLDEEDPKEIEASKYDLNYIPLDGNIGCMVNGAGLAMATMDIIKHYHGDPANFLDVGGGATAEKVTEAFKIILSDKNVKGIFVNIFGGIMKCDVIAEGVVEATKQVGLELPLVVRLEGTNVELGKKILNESGLNIVAAESMADGAQKIVSLV

SEQ ID NO: 1453 - protein, 441 aa, Artificial
  Substituion in SEQ ID NO 1446
MSRFPVCVFIVSTGQDVVKKAAKFYPDRWHKVGRRHGNVCPVFLCAVSVGGQRRTDIVNIHEYQAKAILAEFGVKVPRGKVAFTVEEAVEAAKELGGKAVVKAQIHAGGRGKAGGVKVSKSLEEVEANARELLGKRLVTHQTGPQGRIVRRLLIEELTNIQKEYYIGLVLDRSQGRLVMMASQEGGVEIEEVAAKHPEKIFRETIDPLTGLTPFQANNLAYKLELPQDAVKKAAQFMMALYNAYVAKDCSIAEINPLVLTAEGDIIALDAKLNFDDNALYRHPEIVSLRDEDEEDPKEIEASKYGLSYIALDGNIGCMVNGAGLAMATMDTIKYYGGEPANFLDVGGGASEEKVTAAFKIILSDPKVKGILVNIFGGIMKCDVIANGVVAAAKQVGLDKPLVVRLEGTNVEAGKKILNESGLKLVAADSLADAAQKIVALV

SEQ ID NO: 1454 - protein, 441 aa, Artificial
  Substituion in SEQ ID NO 1446
MSRFPVCVFIVSTGQDVVKRAAKFYPDRWHKVGRRHGNVCPVFLCAVSVGGQRRTDIVNIHEYQAKAILAEFGVKVPRGKVAFTVEEAVEAAKELGGKAVVKAQIHAGGRGKAGGVKVSKSLEEVEANARELLGKRLVTHQTGPQGRIVRRLLIEELTNIQKEYYIGLVLDRSQGRLVMMASQEGGVEIEEVAAKHPEKIFRETIDPLTGLTPFQANNLAYKLELPQDAVKKAAQFMMALYNAYVAKDCSIAEINPLVLTAEGDIIALDAKLNFDDNALYRHPEIVSLRDEDEEDPKEIEASKYGLSYIALDGNIGCMVNGAGLAMATMDTIKYYGGEPANFLDVGGGASEEKVTAAFKIILSDPKVKGILVNIFGGIMKCDVIANGVVAAAKQVGLDKPLVVRLEGTNVEAGKKILNESGLKLIAADSLADAAQKIVALV

SEQ ID NO: 1455 - protein, 441 aa, Artificial
  Substituion in SEQ ID NO 1446
MSRFPVCVFIVSTGQDVVKRAAKFYPDRWHKVGRRHGNVCPVFLCAVSVGGQRRTDIVNIHEYQAKAILAEFGVKVPRGKVAFTVEEAVEAAKELGGKAVVKAQIHAGGRGKAGGVKVSKSLEEVEANARELLGKRLVTHQTGPQGRIVRRLLIEELTNIQKEYYIGLVLDRSQGRLVMMASQEGGVEIEEVAAKHPEKIFRETIDPLTGLTPFQANNLAYKLELPQDAVKKAAQFMMALYNAYVAKDCSIAEINPLVLTAEGDIIALDAKLNFDDNALYRHPEIVSIRDEDEEDPKEIEASKYGLSYIALDGNIGCMVNGAGLAMATMDTIKYYGGEPANFLDVGGGASEEKVTAAFKIILSDPKVKGILVNIFGGIMKCDVIANGVVAAAKQVGLDKPLVVRLEGTNVEAGKKILNESGLKLVAADSLADAAQKIVALV

SEQ ID NO: 1456 - protein, 441 aa, Artificial
  Substituion in SEQ ID NO 1446
MSRFPVCVFIVSTGQDVVKRAAKFYPDRWHKVGRRHGNVCPVFLCAVSVGGQRRTDIVNIHEYQAKAILAEFGVKVPRGKVAFTVEEAVEAAKELGGKAVVKAQIHAGGRGKAGGVKVSKSLEEVEANARELLGKRLVTHQTGPQGRIVRRLLIEELTNIQKEYYIGLVLDRSQGRLVMMASQEGGVEIEEVAAKHPEKIFRETIDPLTGLTPFQANNLAYKLELPQDAVKKAAQFMMALYNAYVAKDCSIAEINPLVLTAEGDIIALDAKLNFDDNALYRHPEIVSLRDEDEEDPKEIEASKYGLSYIALDGNIGCMVNGAGLAMATMDTIKYYGGEPANFLDVGGGASEEKVTAAFKIILSDPKVKGILVNIFGGIMKCDVIANGVVAAAKQVGLDKPLVVRLEGTNVEAGKKILNESGLKLVAAESLADAAQKIVALV

SEQ ID NO: 1457 - protein, 441 aa, Artificial
  Substituion in SEQ ID NO 1446
MSRFPVCVFIVSTGQDVVKRAAKFYPDRWHKVGKRHGNVCPVFLCAVSVGGQRRTDIVNIHEYQAKAILAEFGVKVPRGKVAFTVEEAVEAAKELGGKAVVKAQIHAGGRGKAGGVKVSKSLEEVEANARELLGKRLVTHQTGPQGRIVRRLLIEELTNIQKEYYIGLVLDRSQGRLVMMASQEGGVEIEEVAAKHPEKIFRETIDPLTGLTPFQANNLAYKLELPQDAVKKAAQFMMALYNAYVAKDCSIAEINPLVLTAEGDIIALDAKLNFDDNALYRHPEIVSLRDEDEEDPKEIEASKYGLSYIALDGNIGCMVNGAGLAMATMDTIKYYGGEPANFLDVGGGASEEKVTAAFKIILSDPKVKGILVNIFGGIMKCDVIANGVVAAAKQVGLDKPLVVRLEGTNVEAGKKILNESGLKLVAADSLADAAQKIVALV

SEQ ID NO: 1458 - DNA, 1326 bp, Artificial
  Substituion in SEQ ID NO 1447
ttgtcaaggtttcctgtatgcgttttcatcgtctcaaccggtcaagacgttgtcaaaaaagccgcgaagttctatcctgatagatggcacaaggtcggcagacgccatggcaacgtttgtccggtttttttgtgcgccgtatccgtagggggacaaaggaggacggacatcgtgaacatccacgagtatcaagcgaaggccattctggctgaattcggcgtcaaagtcccgcgcggcaaagtggctttcacggttgaagaggctgtggaagcggcaaaagaacttggtggcaaggctgtagtaaaggctcaaattcatgcaggcgggcgcggcaaggcgggtggcgtcaaagtctcgaagtccctggaggaggtcgaggcgaacgcccgcgagcttctcggcaagcggctcgtcacgcaccaaacgggaccgcagggccgaattgtacggcgactgctcatcgaagagctcacgaatatccagaaggagtactacataggcctcgttcttgaccgatcccagggacgcttggtgatgatggcctcccaggagggcggcgtcgagatcgaagaggtagctgcaaaacacccggaaaagattttccgtgagaccattgatccactgacggggctcacgccgttccaggcgaacaacctcgcgtacaagcttgagctgcctcaggatgcggtgaaaaaggccgctcaattcatgatggcgctttacaacgcgtacgtcgcgaaggattgctccatcgcggagatcaatccgctggtactgacagcggaaggcgacatcatcgccctggatgcgaagctcaacttcgacgacaatgctttgtaccggcatcccgagatcgtcagcctgcgcgacgaggacgaagaagatccgaaggaaatcgaagcctcgaaatacggtttgagttacatcgcgctggacggcaacattggatgcatggtgaatggtgcgggcctggccatggccacgatggacaccatcaagtattacggcggagagcctgcgaacttcctggacgtcggtggaggcgccagcgaagagaaagtgacggcggcgttcaaaatcatcctgtcggatcctaaagtgaaaggtatcctcgtcaacatcttcggcggcatcatgaagtgcgacgtgatcgcaaacggcgtggtcgcagcggccaagcaggtcggcctggacaagccgctcgtggtgcgcctcgagggcacgaacgtcgaagccggaaagaaaatcttgaacgaatcgggtctgaagttggtggcggctgattcgctcgctgacgctgcccaaaagatcgtggcgctggtctga

SEQ ID NO: 1459 - DNA, 1326 bp, Artificial
  Substituion in SEQ ID NO 1447
ttgtcaaggtttcctgtatgcgttttcatcgtctcaaccggtcaagacgttgtcaaacgtgccgcgaagttctatcctgatagatggcacaaggtcggcagacgccatggcaacgtttgtccggtttttttgtgcgccgtatccgtagggggacaaaggaggacggacatcgtgaacatccacgagtatcaagcgaaggccattctggctgaattcggcgtcaaagtcccgcgcggcaaagtggctttcacggttgaagaggctgtggaagcggcaaaagaacttggtggcaaggctgtagtaaaggctcaaattcatgcaggcgggcgcggcaaggcgggtggcgtcaaagtctcgaagtccctggaggaggtcgaggcgaacgcccgcgagcttctcggcaagcggctcgtcacgcaccaaacgggaccgcagggccgaattgtacggcgactgctcatcgaagagctcacgaatatccagaaggagtactacataggcctcgttcttgaccgatcccagggacgcttggtgatgatggcctcccaggagggcggcgtcgagatcgaagaggtagctgcaaaacacccggaaaagattttccgtgagaccattgatccactgacggggctcacgccgttccaggcgaacaacctcgcgtacaagcttgagctgcctcaggatgcggtgaaaaaggccgctcaattcatgatggcgctttacaacgcgtacgtcgcgaaggattgctccatcgcggagatcaatccgctggtactgacagcggaaggcgacatcatcgccctggatgcgaagctcaacttcgacgacaatgctttgtaccggcatcccgagatcgtcagcctgcgcgacgaggacgaagaagatccgaaggaaatcgaagcctcgaaatacggtttgagttacatcgcgctggacggcaacattggatgcatggtgaatggtgcgggcctggccatggccacgatggacaccatcaagtattacggcggagagcctgcgaacttcctggacgtcggtggaggcgccagcgaagagaaagtgacggcggcgttcaaaatcatcctgtcggatcctaaagtgaaaggtatcctcgtcaacatcttcggcggcatcatgaagtgcgacgtgatcgcaaacggcgtggtcgcagcggccaagcaggtcggcctggacaagccgctcgtggtgcgcctcgagggcacgaacgtcgaagccggaaagaaaatcttgaacgaatcgggtctgaagttgattgcggctgattcgctcgctgacgctgcccaaaagatcgtggcgctggtctga

SEQ ID NO: 1460 - DNA, 1326 bp, Artificial
  Substituion in SEQ ID NO 1447
ttgtcaaggtttcctgtatgcgttttcatcgtctcaaccggtcaagacgttgtcaaacgtgccgcgaagttctatcctgatagatggcacaaggtcggcagacgccatggcaacgtttgtccggtttttttgtgcgccgtatccgtagggggacaaaggaggacggacatcgtgaacatccacgagtatcaagcgaaggccattctggctgaattcggcgtcaaagtcccgcgcggcaaagtggctttcacggttgaagaggctgtggaagcggcaaaagaacttggtggcaaggctgtagtaaaggctcaaattcatgcaggcgggcgcggcaaggcgggtggcgtcaaagtctcgaagtccctggaggaggtcgaggcgaacgcccgcgagcttctcggcaagcggctcgtcacgcaccaaacgggaccgcagggccgaattgtacggcgactgctcatcgaagagctcacgaatatccagaaggagtactacataggcctcgttcttgaccgatcccagggacgcttggtgatgatggcctcccaggagggcggcgtcgagatcgaagaggtagctgcaaaacacccggaaaagattttccgtgagaccattgatccactgacggggctcacgccgttccaggcgaacaacctcgcgtacaagcttgagctgcctcaggatgcggtgaaaaaggccgctcaattcatgatggcgctttacaacgcgtacgtcgcgaaggattgctccatcgcggagatcaatccgctggtactgacagcggaaggcgacatcatcgccctggatgcgaagctcaacttcgacgacaatgctttgtaccggcatcccgagatcgtcagcattcgcgacgaggacgaagaagatccgaaggaaatcgaagcctcgaaatacggtttgagttacatcgcgctggacggcaacattggatgcatggtgaatggtgcgggcctggccatggccacgatggacaccatcaagtattacggcggagagcctgcgaacttcctggacgtcggtggaggcgccagcgaagagaaagtgacggcggcgttcaaaatcatcctgtcggatcctaaagtgaaaggtatcctcgtcaacatcttcggcggcatcatgaagtgcgacgtgatcgcaaacggcgtggtcgcagcggccaagcaggtcggcctggacaagccgctcgtggtgcgcctcgagggcacgaacgtcgaagccggaaagaaaatcttgaacgaatcgggtctgaagttggtggcggctgattcgctcgctgacgctgcccaaaagatcgtggcgctggtctga

SEQ ID NO: 1461 - DNA, 1326 bp, Artificial
  Substituion in SEQ ID NO 1447
ttgtcaaggtttcctgtatgcgttttcatcgtctcaaccggtcaagacgttgtcaaacgtgccgcgaagttctatcctgatagatggcacaaggtcggcagacgccatggcaacgtttgtccggtttttttgtgcgccgtatccgtagggggacaaaggaggacggacatcgtgaacatccacgagtatcaagcgaaggccattctggctgaattcggcgtcaaagtcccgcgcggcaaagtggctttcacggttgaagaggctgtggaagcggcaaaagaacttggtggcaaggctgtagtaaaggctcaaattcatgcaggcgggcgcggcaaggcgggtggcgtcaaagtctcgaagtccctggaggaggtcgaggcgaacgcccgcgagcttctcggcaagcggctcgtcacgcaccaaacgggaccgcagggccgaattgtacggcgactgctcatcgaagagctcacgaatatccagaaggagtactacataggcctcgttcttgaccgatcccagggacgcttggtgatgatggcctcccaggagggcggcgtcgagatcgaagaggtagctgcaaaacacccggaaaagattttccgtgagaccattgatccactgacggggctcacgccgttccaggcgaacaacctcgcgtacaagcttgagctgcctcaggatgcggtgaaaaaggccgctcaattcatgatggcgctttacaacgcgtacgtcgcgaaggattgctccatcgcggagatcaatccgctggtactgacagcggaaggcgacatcatcgccctggatgcgaagctcaacttcgacgacaatgctttgtaccggcatcccgagatcgtcagcctgcgcgacgaggacgaagaagatccgaaggaaatcgaagcctcgaaatacggtttgagttacatcgcgctggacggcaacattggatgcatggtgaatggtgcgggcctggccatggccacgatggacaccatcaagtattacggcggagagcctgcgaacttcctggacgtcggtggaggcgccagcgaagagaaagtgacggcggcgttcaaaatcatcctgtcggatcctaaagtgaaaggtatcctcgtcaacatcttcggcggcatcatgaagtgcgacgtgatcgcaaacggcgtggtcgcagcggccaagcaggtcggcctggacaagccgctcgtggtgcgcctcgagggcacgaacgtcgaagccggaaagaaaatcttgaacgaatcgggtctgaagttggtggcggctgaatcgctcgctgacgctgcccaaaagatcgtggcgctggtctga

SEQ ID NO: 1462 - DNA, 1326 bp, Artificial
  Substituion in SEQ ID NO 1447
ttgtcaaggtttcctgtatgcgttttcatcgtctcaaccggtcaagacgttgtcaaacgtgccgcgaagttctatcctgatagatggcacaaggtcggcaaacgccatggcaacgtttgtccggtttttttgtgcgccgtatccgtagggggacaaaggaggacggacatcgtgaacatccacgagtatcaagcgaaggccattctggctgaattcggcgtcaaagtcccgcgcggcaaagtggctttcacggttgaagaggctgtggaagcggcaaaagaacttggtggcaaggctgtagtaaaggctcaaattcatgcaggcgggcgcggcaaggcgggtggcgtcaaagtctcgaagtccctggaggaggtcgaggcgaacgcccgcgagcttctcggcaagcggctcgtcacgcaccaaacgggaccgcagggccgaattgtacggcgactgctcatcgaagagctcacgaatatccagaaggagtactacataggcctcgttcttgaccgatcccagggacgcttggtgatgatggcctcccaggagggcggcgtcgagatcgaagaggtagctgcaaaacacccggaaaagattttccgtgagaccattgatccactgacggggctcacgccgttccaggcgaacaacctcgcgtacaagcttgagctgcctcaggatgcggtgaaaaaggccgctcaattcatgatggcgctttacaacgcgtacgtcgcgaaggattgctccatcgcggagatcaatccgctggtactgacagcggaaggcgacatcatcgccctggatgcgaagctcaacttcgacgacaatgctttgtaccggcatcccgagatcgtcagcctgcgcgacgaggacgaagaagatccgaaggaaatcgaagcctcgaaatacggtttgagttacatcgcgctggacggcaacattggatgcatggtgaatggtgcgggcctggccatggccacgatggacaccatcaagtattacggcggagagcctgcgaacttcctggacgtcggtggaggcgccagcgaagagaaagtgacggcggcgttcaaaatcatcctgtcggatcctaaagtgaaaggtatcctcgtcaacatcttcggcggcatcatgaagtgcgacgtgatcgcaaacggcgtggtcgcagcggccaagcaggtcggcctggacaagccgctcgtggtgcgcctcgagggcacgaacgtcgaagccggaaagaaaatcttgaacgaatcgggtctgaagttggtggcggctgattcgctcgctgacgctgcccaaaagatcgtggcgctggtctga

SEQ ID NO: 1463 - protein, 299 aa, Alicyclobacillus acidocaldarius
MSILVNKETRVITQGITGSAGLFHTQQALAYGTKVVGGTSPGKGGTKVEGLPVFNTVEEAVRETGANASVIYVPPAFAADAIMEAVAAGIELVVCITEGIPILDMVKVKRYMEGKKTRLIGPNCPGVITPNECKIGIMPGYIHTPGKIGVVSRSGTLTYEAVYQLTQLGLGQSTAVGIGGDPVNGTNFVDVLKMFNDDPDTEAVIMIGEIGGSAEEEAAEWIKANMKKPVVGFIAGATAPPGRRMGHAGAIVSGGSGTAQSKIEKMKACGIRVAPTPSEMGSTLYQVLEERGLLERCKS

SEQ ID NO: 1464 - DNA, 900 bp, Alicyclobacillus acidocaldarius
atgagcattctggtgaacaaggaaacgcgcgtcattacccagggcatcacgggatctgccggtctgtttcacacgcagcaggcgcttgcctacggcacgaaggtcgtgggtggcacctccccagggaagggcggcacaaaggtcgagggattgccggtcttcaacacggttgaggaggccgtgcgcgagacgggcgcaaatgcgtcggtcatttacgttccgcctgcattcgccgcggacgccatcatggaggccgttgcggccggaatcgaacttgtcgtgtgcatcacggaaggtattccgattcttgatatggtgaaggtcaagcggtacatggagggcaagaagacgcggctcattggcccgaactgtcctggcgtgatcacgccgaacgagtgcaagatcggcatcatgcctggatacattcacacgcctggaaaaatcggcgtcgtgtctcgctcgggaacgctgacctacgaagccgtgtaccagttgacgcagctcgggctcggccagtcgacggccgtcgggatcggcggcgatccggtcaacgggacaaactttgtcgacgtgctgaagatgttcaacgacgacccggataccgaagccgtgatcatgatcggcgagatcggtggatcggcggaagaagaagcggcagagtggattaaggccaacatgaaaaagcccgtcgttggctttatcgcgggtgccacagcccctccgggaaggcggatgggtcatgcgggggcgattgtgtccggtggttccggcacggcgcagtccaagatcgagaagatgaaggcgtgcggcatccgagtggctcccaccccgtctgagatgggctcgacgttgtatcaggtgctggaagagcgcggcttgctcgagcgctgcaagtcgtga

SEQ ID NO: 1465 - protein, 299 aa, Geobacillus kaustophilus HTA426
MSVFVNKDTKVIVQGITGSQGLFHTKQMIEYGTNIVGGVTPGKGGTEVEGVPVFDTVSEAVERTGANASVIYVPPAFAADAIMEAVDAGLDLVVCITEGIPVLDMVKVKRYMEGKKTRLIGPNCPGVITPEECKIGIMPGYIHKKGHVGIVSRSGTLTYEAVHQLTQAGIGQSTAVGIGGDPVNGTNFIDVLKAFNEDEETYAVIMIGEIGGTAEEEAAEWVKANMTKPVVGFIGGQTAPPGKRMGHAGAIISGGKGTAAEKIKKMTECGIKVAETPAVIGETLISVLKERGLYEKCKT

SEQ ID NO: 1466 - protein, 299 aa, Geobacillus thermodenitrificans NG80-2
MSVFVNKDTKVIVQGITGSQGLFHTKQMIEYGTNIVGGVTPGKGGTEVEGVPVFDTVSEAVEKTGANASVIYVPPAFAADAIMEAVDAELDLVVCITEGIPVLDMVKVKRYMEGKKTRLIGPNCPGVITPEECKIGIMPGYIHKKGHVGIVSRSGTLTYEAVHQLTQAGIGQSTAVGIGGDPVNGTNFIDVLKAFNEDDETYAVIMIGEIGGTAEEEAAEWVKANMTKPVVGFIGGQTAPPGKRMGHAGAIISGGKGTAAEKIKKMNECGIKVAETPAVIGETLISVLKERGLYEKCKT

SEQ ID NO: 1467 - protein, 299 aa, Bacillus licheniformis ATCC 14580
MSVFINKDTKVIVQGITGSTALFHTKQMLEYGTKIVGGVTPGKGGTEVEGVPVFNTVEEAVKQTGANASVIYVPAAFAADAIMEATDAELDLVICITEHIPVLDMVKVKRYMEGKKTRLIGPNCPGVITPEECKIGIMPGYIHKKGHVGVVSRSGTLTYEAVHQLSEAGVGQSTAVGIGGDPVNGTNFIDVLKAFNEDPDTHAVIMIGEIGGTAEEEAAEWVKANMTKPVVGFIGGKTAPPGKRMGHAGAIISGGKGTADEKIKTMNACGIEVAETPSVMGETLIKVLKEKGLYETCKT

SEQ ID NO: 1468 - protein, 297 aa, Bacillus halodurans C-125
MSILINKDTKVIVQGITGATGLFHTKQAVEYGTNIVGGVTPGKGGTEVEGIPVFDTVSQAVEATGANASVIYVPPAFAADAIMEAVDAELDLAICITEGIPVMDMVKVKRYMEGKKTRLVGPNCPGVITPEECKIGIMPGYIHKKGHVGVVSRSGTLTYEAVHQLSTAGIGQSTAVGIGGDPVNGTNFIDVLKLFNEDPDTYAVIMIGEIGGTAEEEAAEWIKANMTKPVVGFIGGQTAPPGKRMGHAGAIISGGKGTAAEKIKTLESCGVKVAETPSVMGETLISVLKEQGLLEKC

SEQ ID NO: 1469 - protein, 299 aa, Bacillus sp. NRRL B-14911
MSVFINKDTKVIVQGITGSTALFHTKQMLEYGTQIVGGTTPGKGGMEVEGVPVFNTVQEAVKETGATASVIYVPAAFAADAILEAVDAELDLAICITEHIPVLDMVKVKRYMEGKKTRLVGPNCPGVITPDECKIGIMPGYIHTKGHVGVVSRSGTLTYEAVHQLTQAGIGQSTAVGIGGDPVNGTNFIDVLKAFNEDPETKAVIMIGEIGGTAEEEAAEWVKANMTKPVVGFIGGRTAPPGKRMGHAGAIISGGKGTADEKIRVMNECGIQVADTPSVMGETLIKVLKEKGLFDECKT

SEQ ID NO: 1470 - protein, 299 aa, Artificial
  Substituion in SEQ ID NO 1463
MSILVNKETRVITQGITGSAGLFHTQQALAYGTKVVGGTSPGKGGTKVEGLPVFNTVEEAVRETGANASVIYVPPAFAADAIMEAVAAGIELVVCITEGIPILDMVKVKRYMEGKKTRLIGPNCPGVITPNECKIGIMPGYIHTPGKIGVVSRSGTLTYEAVYQLTQLGLGQSTAVGIGGDPVNGTNFVDVLKMFNDDPDTDAVIMIGEIGGSAEEEAAEWIKANMKKPVVGFIAGATAPPGRRMGHAGAIVSGGSGTAQSKIEKMKACGIRVAPTPSEMGSTLYQVLEERGLLERCKS

SEQ ID NO: 1471 - protein, 299 aa, Artificial
  Substituion in SEQ ID NO 1463
MSILVNKETRVITQGITGSAGLFHTQQALAYGTKVVGGTSPGKGGTKVEGLPVFNTVEEAVRETGANASVIYVPPAFAADAIMEAVAAGIELVVCITEGIPILDMVKVKRYMEGKKTRLIGPNCPGVITPNECKIGIMPGYIHTPGKIGVVSRSGTLTYEAVYQLTQLGLGQSTAVGIGGDPVNGTNFVDVLKMFNDDPDTEAVIMIGEIGGSAEEEAAEWIKANMKKPVVGFIAGATAPPGRRMGHAGAIVSGGSGTAQSKIEKMRACGIRVAPTPSEMGSTLYQVLEERGLLERCKS

SEQ ID NO: 1472 - protein, 299 aa, Artificial
  Substituion in SEQ ID NO 1463
MSILVNKETRVITQGITGSAGLFHTQQALAYGTKVVGGTSPGKGGTKVEGLPVFNTVEEAVRETGANASVIYVPPAFAADAIMEAVAAGIELVVCITEGIPILDMVKVKRYMEGKKTRLIGPNCPGVITPNECKIGIMPGYIHTPGKIGVVSRSGTLTYEAVYQLTQLGLGQSTAVGIGGDPVNGTNFVDVLKMFNDDPDTEAVIMIGEIGGSAEEEAAEWIKANMKKPVVGFIAGATAPPGRRMGHAGAIVSGGSGTAQSKIERMKACGIRVAPTPSEMGSTLYQVLEERGLLERCKS

SEQ ID NO: 1473 - protein, 299 aa, Artificial
  Substituion in SEQ ID NO 1463
MSILVNKETRVITQGITGSAGLFHTQQALAYGTKVVGGTSPGKGGTKVEGLPVFNTVEEAVRDTGANASVIYVPPAFAADAIMEAVAAGIELVVCITEGIPILDMVKVKRYMEGKKTRLIGPNCPGVITPNECKIGIMPGYIHTPGKIGVVSRSGTLTYEAVYQLTQLGLGQSTAVGIGGDPVNGTNFVDVLKMFNDDPDTEAVIMIGEIGGSAEEEAAEWIKANMKKPVVGFIAGATAPPGRRMGHAGAIVSGGSGTAQSKIEKMKACGIRVAPTPSEMGSTLYQVLEERGLLERCKS

SEQ ID NO: 1474 - protein, 299 aa, Artificial
  Substituion in SEQ ID NO 1463
MSILVNKETRVITQGITGSAGLFHTQQALAYGTKVVGGTSPGKGGTKVEGLPVFNTVEEAVRETGANASVIYVPPAFAADAIMEAVAAGIELVVCITEGIPILDMVKVKRYMEGKKTRLIGPNCPGVITPNECKIGIMPGYIHTPGKIGVVSRSGTLTYEAVYQLTQIGLGQSTAVGIGGDPVNGTNFVDVLKMFNDDPDTEAVIMIGEIGGSAEEEAAEWIKANMKKPVVGFIAGATAPPGRRMGHAGAIVSGGSGTAQSKIEKMKACGIRVAPTPSEMGSTLYQVLEERGLLERCKS

SEQ ID NO: 1475 - DNA, 900 bp, Artificial
  Substituion in SEQ ID NO 1464
atgagcattctggtgaacaaggaaacgcgcgtcattacccagggcatcacgggatctgccggtctgtttcacacgcagcaggcgcttgcctacggcacgaaggtcgtgggtggcacctccccagggaagggcggcacaaaggtcgagggattgccggtcttcaacacggttgaggaggccgtgcgcgagacgggcgcaaatgcgtcggtcatttacgttccgcctgcattcgccgcggacgccatcatggaggccgttgcggccggaatcgaacttgtcgtgtgcatcacggaaggtattccgattcttgatatggtgaaggtcaagcggtacatggagggcaagaagacgcggctcattggcccgaactgtcctggcgtgatcacgccgaacgagtgcaagatcggcatcatgcctggatacattcacacgcctggaaaaatcggcgtcgtgtctcgctcgggaacgctgacctacgaagccgtgtaccagttgacgcagctcgggctcggccagtcgacggccgtcgggatcggcggcgatccggtcaacgggacaaactttgtcgacgtgctgaagatgttcaacgacgacccggataccgatgccgtgatcatgatcggcgagatcggtggatcggcggaagaagaagcggcagagtggattaaggccaacatgaaaaagcccgtcgttggctttatcgcgggtgccacagcccctccgggaaggcggatgggtcatgcgggggcgattgtgtccggtggttccggcacggcgcagtccaagatcgagaagatgaaggcgtgcggcatccgagtggctcccaccccgtctgagatgggctcgacgttgtatcaggtgctggaagagcgcggcttgctcgagcgctgcaagtcgtga

SEQ ID NO: 1476 - DNA, 900 bp, Artificial
  Substituion in SEQ ID NO 1464
atgagcattctggtgaacaaggaaacgcgcgtcattacccagggcatcacgggatctgccggtctgtttcacacgcagcaggcgcttgcctacggcacgaaggtcgtgggtggcacctccccagggaagggcggcacaaaggtcgagggattgccggtcttcaacacggttgaggaggccgtgcgcgagacgggcgcaaatgcgtcggtcatttacgttccgcctgcattcgccgcggacgccatcatggaggccgttgcggccggaatcgaacttgtcgtgtgcatcacggaaggtattccgattcttgatatggtgaaggtcaagcggtacatggagggcaagaagacgcggctcattggcccgaactgtcctggcgtgatcacgccgaacgagtgcaagatcggcatcatgcctggatacattcacacgcctggaaaaatcggcgtcgtgtctcgctcgggaacgctgacctacgaagccgtgtaccagttgacgcagctcgggctcggccagtcgacggccgtcgggatcggcggcgatccggtcaacgggacaaactttgtcgacgtgctgaagatgttcaacgacgacccggataccgaagccgtgatcatgatcggcgagatcggtggatcggcggaagaagaagcggcagagtggattaaggccaacatgaaaaagcccgtcgttggctttatcgcgggtgccacagcccctccgggaaggcggatgggtcatgcgggggcgattgtgtccggtggttccggcacggcgcagtccaagatcgagaagatgcgtgcgtgcggcatccgagtggctcccaccccgtctgagatgggctcgacgttgtatcaggtgctggaagagcgcggcttgctcgagcgctgcaagtcgtga

SEQ ID NO: 1477 - DNA, 900 bp, Artificial
  Substituion in SEQ ID NO 1464
atgagcattctggtgaacaaggaaacgcgcgtcattacccagggcatcacgggatctgccggtctgtttcacacgcagcaggcgcttgcctacggcacgaaggtcgtgggtggcacctccccagggaagggcggcacaaaggtcgagggattgccggtcttcaacacggttgaggaggccgtgcgcgagacgggcgcaaatgcgtcggtcatttacgttccgcctgcattcgccgcggacgccatcatggaggccgttgcggccggaatcgaacttgtcgtgtgcatcacggaaggtattccgattcttgatatggtgaaggtcaagcggtacatggagggcaagaagacgcggctcattggcccgaactgtcctggcgtgatcacgccgaacgagtgcaagatcggcatcatgcctggatacattcacacgcctggaaaaatcggcgtcgtgtctcgctcgggaacgctgacctacgaagccgtgtaccagttgacgcagctcgggctcggccagtcgacggccgtcgggatcggcggcgatccggtcaacgggacaaactttgtcgacgtgctgaagatgttcaacgacgacccggataccgaagccgtgatcatgatcggcgagatcggtggatcggcggaagaagaagcggcagagtggattaaggccaacatgaaaaagcccgtcgttggctttatcgcgggtgccacagcccctccgggaaggcggatgggtcatgcgggggcgattgtgtccggtggttccggcacggcgcagtccaagatcgagcgtatgaaggcgtgcggcatccgagtggctcccaccccgtctgagatgggctcgacgttgtatcaggtgctggaagagcgcggcttgctcgagcgctgcaagtcgtga

SEQ ID NO: 1478 - DNA, 900 bp, Artificial
  Substituion in SEQ ID NO 1464
atgagcattctggtgaacaaggaaacgcgcgtcattacccagggcatcacgggatctgccggtctgtttcacacgcagcaggcgcttgcctacggcacgaaggtcgtgggtggcacctccccagggaagggcggcacaaaggtcgagggattgccggtcttcaacacggttgaggaggccgtgcgcgatacgggcgcaaatgcgtcggtcatttacgttccgcctgcattcgccgcggacgccatcatggaggccgttgcggccggaatcgaacttgtcgtgtgcatcacggaaggtattccgattcttgatatggtgaaggtcaagcggtacatggagggcaagaagacgcggctcattggcccgaactgtcctggcgtgatcacgccgaacgagtgcaagatcggcatcatgcctggatacattcacacgcctggaaaaatcggcgtcgtgtctcgctcgggaacgctgacctacgaagccgtgtaccagttgacgcagctcgggctcggccagtcgacggccgtcgggatcggcggcgatccggtcaacgggacaaactttgtcgacgtgctgaagatgttcaacgacgacccggataccgaagccgtgatcatgatcggcgagatcggtggatcggcggaagaagaagcggcagagtggattaaggccaacatgaaaaagcccgtcgttggctttatcgcgggtgccacagcccctccgggaaggcggatgggtcatgcgggggcgattgtgtccggtggttccggcacggcgcagtccaagatcgagaagatgaaggcgtgcggcatccgagtggctcccaccccgtctgagatgggctcgacgttgtatcaggtgctggaagagcgcggcttgctcgagcgctgcaagtcgtga

SEQ ID NO: 1479 - DNA, 900 bp, Artificial
  Substituion in SEQ ID NO 1464
atgagcattctggtgaacaaggaaacgcgcgtcattacccagggcatcacgggatctgccggtctgtttcacacgcagcaggcgcttgcctacggcacgaaggtcgtgggtggcacctccccagggaagggcggcacaaaggtcgagggattgccggtcttcaacacggttgaggaggccgtgcgcgagacgggcgcaaatgcgtcggtcatttacgttccgcctgcattcgccgcggacgccatcatggaggccgttgcggccggaatcgaacttgtcgtgtgcatcacggaaggtattccgattcttgatatggtgaaggtcaagcggtacatggagggcaagaagacgcggctcattggcccgaactgtcctggcgtgatcacgccgaacgagtgcaagatcggcatcatgcctggatacattcacacgcctggaaaaatcggcgtcgtgtctcgctcgggaacgctgacctacgaagccgtgtaccagttgacgcagattgggctcggccagtcgacggccgtcgggatcggcggcgatccggtcaacgggacaaactttgtcgacgtgctgaagatgttcaacgacgacccggataccgaagccgtgatcatgatcggcgagatcggtggatcggcggaagaagaagcggcagagtggattaaggccaacatgaaaaagcccgtcgttggctttatcgcgggtgccacagcccctccgggaaggcggatgggtcatgcgggggcgattgtgtccggtggttccggcacggcgcagtccaagatcgagaagatgaaggcgtgcggcatccgagtggctcccaccccgtctgagatgggctcgacgttgtatcaggtgctggaagagcgcggcttgctcgagcgctgcaagtcgtga

SEQ ID NO: 1480 - protein, 167 aa, Alicyclobacillus acidocaldarius
MFQVGGIFQVGTFIFSVISFLIVFFIIQRFAFKPLARMLEQRRIHIETQISEAEKSREEAERLLAEQQRLLEEARKEARNLLDQARIRADEQAREIVQKAEEEAARILEESRQAIVRERDEALAAVTKRVAELSVELTTKLLRDHVTAELHKELVAEAESKLGELVC

SEQ ID NO: 1481 - DNA, 504 bp, Alicyclobacillus acidocaldarius
gtgttccaggtgggcggcatctttcaagttggaacgttcatcttctccgtgatctcgttcctcatcgtgttcttcatcattcagcggtttgcgttcaagccgctggcgcgaatgctggaacagcggagaattcatatcgagacccagatcagcgaggccgaaaagagccgcgaagaagcagagcggctgctggccgaacaacagcgcttgttggaagaggcgcgcaaagaagcgcggaacctgctggatcaagcccgcattcgcgccgatgagcaggcgcgcgagatcgtgcagaaggccgaagaggaggctgcccggattctcgaggagagccgccaagccattgtccgcgagcgggacgaggcgctggccgccgtcacgaagcgcgtggcggagttgtctgtcgaattgaccaccaagttgctgcgcgatcacgtcacggccgaattgcacaaggaactcgtggcagaggccgagagcaagctgggtgagctcgtatgctga

SEQ ID NO: 1482 - protein, 128 aa, Geobacillus thermodenitrificans NG80-2
RKFAWGPLMGVMKQREEHIANEIDQAEKRRQEAEKLLEEQRELLKQSRQEAQTILENARKLAEEQKEQIVASARAEAERVKEAAKQEIEREKEQAMAALREQVASLSVLIASKVIERELTEQDQRKLI

SEQ ID NO: 1483 - protein, 140 aa, Desulfitobacterium hafniense Y51
RRFAWNPLINMMEERRSQIEANIANAEKERLQAEQIKREYQEEMRKARQEAQEVIAKATKLSEQRAAEILAAAHGEAEKIKQSALADIERERDRAIAQVQAQVADLSVAVAEKIIRKNLDVRGQEDMIEQFIQEVGELPC

SEQ ID NO: 1484 - protein, 128 aa, Geobacillus kaustophilus HTA426
RKFAWQPLMNIMKQREEHIANEIDQAEKRRQEAEKLLEEQRELMKQSRQEAQALIENARKLAEEQKEQIVASARAEAERVKEVAKKEIEREKEQAMAALREQVASLSVLIASKVIEKELTEQDQRKLI

SEQ ID NO: 1485 - protein, 137 aa, Bacillus pumilus SAFR-032
KKFALKPLLGIMKQREDYIGNEISSAEQKHVQAEKLLEEQRVLLKEAREESHTLIENAKKIGEKQKEEIIQAARQESERLKDSARTEIVKEKEQAVAALREQVASLSVLIASKVIERELDEQAQEKLIQEYLKEAGE

SEQ ID NO: 1486 - protein, 157 aa, Bacillus licheniformis ATCC 14580
FNAGTMLFQLVAMLILLALLKKYALGPLLNIMKEREDYITGEISSAEKKNEEAKKLIEEQQALLKEAREESQSLIENAKKLGEQQKDEIIKAARQEAERMKESARSEIVKERDQAVTALREQVASLSVMIASKVIEKELDEQAQEKLIQDYLKEVGE

SEQ ID NO: 1487 - protein, 167 aa, Artificial
  Substituion in SEQ ID NO 1480
MFQVGGIFQVGTFIFSVISFLIVFFIIQRFAFKPLARMLEQRRIHIETQISEAEKSREEAERLLAENQRLLEEARKEARNLLDQARIRADEQAREIVQKAEEEAARILEESRQAIVRERDEALAAVTKRVAELSVELTTKLLRDHVTAELHKELVAEAESKLGELVC

SEQ ID NO: 1488 - protein, 167 aa, Artificial
  Substituion in SEQ ID NO 1480
MFQVGGIFNVGTFIFSVISFLIVFFIIQRFAFKPLARMLEQRRIHIETQISEAEKSREEAERLLAEQQRLLEEARKEARNLLDQARIRADEQAREIVQKAEEEAARILEESRQAIVRERDEALAAVTKRVAELSVELTTKLLRDHVTAELHKELVAEAESKLGELVC

SEQ ID NO: 1489 - protein, 167 aa, Artificial
  Substituion in SEQ ID NO 1480
MFQVGGIFQVGTFIFSVISFLIVFFIIQRFAFKPLARMLEQRRIHIETQISEAEKSREEAERLLAEQQRILEEARKEARNLLDQARIRADEQAREIVQKAEEEAARILEESRQAIVRERDEALAAVTKRVAELSVELTTKLLRDHVTAELHKELVAEAESKLGELVC

SEQ ID NO: 1490 - protein, 167 aa, Artificial
  Substituion in SEQ ID NO 1480
MFQVGGIFQVGTFIFSVISFLIVFFILQRFAFKPLARMLEQRRIHIETQISEAEKSREEAERLLAEQQRLLEEARKEARNLLDQARIRADEQAREIVQKAEEEAARILEESRQAIVRERDEALAAVTKRVAELSVELTTKLLRDHVTAELHKELVAEAESKLGELVC

SEQ ID NO: 1491 - protein, 167 aa, Artificial
  Substituion in SEQ ID NO 1480
MFQVGGIFQVGTFIFSVISFLIVFFIIQRFAFKPLARMLEQRRIHIETQISEAEKSRDEAERLLAEQQRLLEEARKEARNLLDQARIRADEQAREIVQKAEEEAARILEESRQAIVRERDEALAAVTKRVAELSVELTTKLLRDHVTAELHKELVAEAESKLGELVC

SEQ ID NO: 1492 - DNA, 504 bp, Artificial
  Substituion in SEQ ID NO 1481
gtgttccaggtgggcggcatctttcaagttggaacgttcatcttctccgtgatctcgttcctcatcgtgttcttcatcattcagcggtttgcgttcaagccgctggcgcgaatgctggaacagcggagaattcatatcgagacccagatcagcgaggccgaaaagagccgcgaagaagcagagcggctgctggccgaaaatcagcgcttgttggaagaggcgcgcaaagaagcgcggaacctgctggatcaagcccgcattcgcgccgatgagcaggcgcgcgagatcgtgcagaaggccgaagaggaggctgcccggattctcgaggagagccgccaagccattgtccgcgagcgggacgaggcgctggccgccgtcacgaagcgcgtggcggagttgtctgtcgaattgaccaccaagttgctgcgcgatcacgtcacggccgaattgcacaaggaactcgtggcagaggccgagagcaagctgggtgagctcgtatgctga

SEQ ID NO: 1493 - DNA, 504 bp, Artificial
  Substituion in SEQ ID NO 1481
gtgttccaggtgggcggcatctttaatgttggaacgttcatcttctccgtgatctcgttcctcatcgtgttcttcatcattcagcggtttgcgttcaagccgctggcgcgaatgctggaacagcggagaattcatatcgagacccagatcagcgaggccgaaaagagccgcgaagaagcagagcggctgctggccgaacaacagcgcttgttggaagaggcgcgcaaagaagcgcggaacctgctggatcaagcccgcattcgcgccgatgagcaggcgcgcgagatcgtgcagaaggccgaagaggaggctgcccggattctcgaggagagccgccaagccattgtccgcgagcgggacgaggcgctggccgccgtcacgaagcgcgtggcggagttgtctgtcgaattgaccaccaagttgctgcgcgatcacgtcacggccgaattgcacaaggaactcgtggcagaggccgagagcaagctgggtgagctcgtatgctga

SEQ ID NO: 1494 - DNA, 504 bp, Artificial
  Substituion in SEQ ID NO 1481
gtgttccaggtgggcggcatctttcaagttggaacgttcatcttctccgtgatctcgttcctcatcgtgttcttcatcattcagcggtttgcgttcaagccgctggcgcgaatgctggaacagcggagaattcatatcgagacccagatcagcgaggccgaaaagagccgcgaagaagcagagcggctgctggccgaacaacagcgcattttggaagaggcgcgcaaagaagcgcggaacctgctggatcaagcccgcattcgcgccgatgagcaggcgcgcgagatcgtgcagaaggccgaagaggaggctgcccggattctcgaggagagccgccaagccattgtccgcgagcgggacgaggcgctggccgccgtcacgaagcgcgtggcggagttgtctgtcgaattgaccaccaagttgctgcgcgatcacgtcacggccgaattgcacaaggaactcgtggcagaggccgagagcaagctgggtgagctcgtatgctga

SEQ ID NO: 1495 - DNA, 504 bp, Artificial
  Substituion in SEQ ID NO 1481
gtgttccaggtgggcggcatctttcaagttggaacgttcatcttctccgtgatctcgttcctcatcgtgttcttcatcttacagcggtttgcgttcaagccgctggcgcgaatgctggaacagcggagaattcatatcgagacccagatcagcgaggccgaaaagagccgcgaagaagcagagcggctgctggccgaacaacagcgcttgttggaagaggcgcgcaaagaagcgcggaacctgctggatcaagcccgcattcgcgccgatgagcaggcgcgcgagatcgtgcagaaggccgaagaggaggctgcccggattctcgaggagagccgccaagccattgtccgcgagcgggacgaggcgctggccgccgtcacgaagcgcgtggcggagttgtctgtcgaattgaccaccaagttgctgcgcgatcacgtcacggccgaattgcacaaggaactcgtggcagaggccgagagcaagctgggtgagctcgtatgctga

SEQ ID NO: 1496 - DNA, 504 bp, Artificial
  Substituion in SEQ ID NO 1481
gtgttccaggtgggcggcatctttcaagttggaacgttcatcttctccgtgatctcgttcctcatcgtgttcttcatcattcagcggtttgcgttcaagccgctggcgcgaatgctggaacagcggagaattcatatcgagacccagatcagcgaggccgaaaagagccgcgatgaagcagagcggctgctggccgaacaacagcgcttgttggaagaggcgcgcaaagaagcgcggaacctgctggatcaagcccgcattcgcgccgatgagcaggcgcgcgagatcgtgcagaaggccgaagaggaggctgcccggattctcgaggagagccgccaagccattgtccgcgagcgggacgaggcgctggccgccgtcacgaagcgcgtggcggagttgtctgtcgaattgaccaccaagttgctgcgcgatcacgtcacggccgaattgcacaaggaactcgtggcagaggccgagagcaagctgggtgagctcgtatgctga

SEQ ID NO: 1497 - protein, 298 aa, Alicyclobacillus acidocaldarius
MRMDFGSLITAMVTPFDATGALDEGRLRRLVDHLIETGTTAVVVCGTTGESPTLSHAEKLRLFDATLRAVDGRIPVIAGTGTNSTKDSIELTLEAARLGVQAVMLVTPYYNRPSQEGLYMHFASIAESTTLPVMLYNVPGRTGVNLQPQTALQLAAIPNVVALKEASGDFSQILRIAAEKPDDFLLYSGDDKFTLPMLAIGAAGVVSVAGHVVGRQIRTMMDLFWQGQVDEAAYWSARLLPIFEAMFMEASPAPVKEALSILGIDVGSVRSPLVPASKALREHLYTLLNALGVIEPSA

SEQ ID NO: 1498 - DNA, 897 bp, Alicyclobacillus acidocaldarius
atgcgtatggattttggaagcctgatcacggcgatggtcacgccctttgatgccacgggtgcgctcgacgaggggcgcctgcggcggctggtggaccacctgatcgaaacgggcacgaccgcggtcgtggtgtgcgggacgacgggggaatccccaaccctgagccacgcggaaaagctgcgcctgttcgacgccaccctccgggcggtggacggccggattccggtgatcgcgggcacgggcaccaattcgaccaaggattccattgagctcacgctcgaggccgctcgtctcggcgtgcaggccgtcatgctcgtgacgccgtattacaaccgcccgtctcaggaagggctgtacatgcacttcgccagcatcgcggagtcgaccaccttgccggtcatgttgtacaacgtgccggggcggacgggggtcaatctgcagccgcagaccgcgcttcagctcgcggccatcccgaacgtcgtcgcgctcaaggaggcgagcggcgacttttcgcagatcctccgcatcgcggccgagaagccggacgactttcttctctacagcggggacgacaagttcacgttgccgatgctcgccatcggagcggcgggcgtcgtgagcgtcgcgggccacgtcgtcggtcggcagatccgcacgatgatggatctcttctggcaagggcaggtggacgaggcggcgtactggagcgcgcggctgttgcccatcttcgaggccatgtttatggaggccagcccggcgccggtgaaggaggcgctttccatcctcggcatcgacgtgggctccgtccgctcgccgcttgtgccggcctccaaggcgctccgcgagcacctgtacacgcttctgaacgcgctcggggtcatcgagccaagcgcatga

SEQ ID NO: 1499 - protein, 289 aa, Bacillus amyloliquefaciens FZB42
MNVGNISTAMITPFDSKGNVDFQKLSTLIDYLLKNGTDSLVVAGTTGESPTLSTEEKIALFEFTVKEVNGRVPVIAGTGSNNTKDSIKLTKKAEEAGVDCVMLVTPYYNKPSQEGMYRHFKAIAEETSLPVMLYNVPGRTVASLAPETAIRLAEIPNISAIKEASGDLDAITKIIAETPEDFYVYSGDDGLTLPILAVGGRGVVSVASHIVGSDMQQMIKNYTNGQTATAALIHQKLLPIMKELFKAPNPAPVKTALQLKGLDVGSVRLPLIPLNEDERLSLSSVISEL

SEQ ID NO: 1500 - protein, 290 aa, Bacillus subtilis subsp. subtilis str. 168
MNFGNVSTAMITPFDNKGNVDFQKLSTLIDYLLKNGTDSLVVAGTTGESPTLSTEEKIALFEYTVKEVNGRVPVIAGTGSNNTKDSIKLTKKAEEAGVDAVMLVTPYYNKPSQEGMYQHFKAIAAETSLPVMLYNVPGRTVASLAPETTIRLAADIPNVVAIKEASGDLEAITKIIAETPEDFYVYSGDDALTLPILSVGGRGVVSVASHIAGTDMQQMIKNYTNGQTANAALIHQKLLPIMKELFKAPNPAPVKTALQLRGLDVGSVRLPLVPLTEDERLSLSSTISEL

SEQ ID NO: 1501 - protein, 287 aa, Geobacillus thermodenitrificans NG80-2
FGNIVTAMVTPFDRKGNLDLAKTTELVNYLLDNGTDALVVAGTTGESPTLTAEEKVALFRHVVNVVNGRVPVIAGTGTNDTRASIELTKRAEETGVDAVMLVAPYYNKPNQEGLYQHFKAIAESTSLPVMLYNVPGRTSVNLAPETVIRLAAIPNIVAVKEAGGNLDAMAEIIEQTPDDFLLYSGDDSLTLPVLAIGGAGVVSVASHIIGNEMQQMIRAFQAGDHQKAAALHRKWVPLMKGLFAAPSPVPVKTALQLRGLDVGPVRLPLVPLTEQERSELSRLLSAL

SEQ ID NO: 1502 - protein, 286 aa, Bacillus selenitireducens MLS10
MSFGTVLTAMVTPFDDQGMINYDQLEVLINHLIENGSDGLVVGGTTGESATLSIEEKAALYQQSVRIADGRVPIIAGTGMNDTYATAELTIRAERVGVDGIMLVAPYYNKPSQKGLYEHFQTIAEKTSLPVMVYNVPGRTAVNILPETVIELAKIENITSVKEASGNLDQVTMIVANTPDDFTVYSGDDSLTLPSLAVGADGIVSVSSHIIGKHMQQMVRYYKDGQVGEAALLHQKLLPIMRGMFIAPSPAPVKTALDMTGLDVGGVRLPLVPLTEEERKTLESIV

SEQ ID NO: 1503 - protein, 289 aa, Bacillus licheniformis ATCC 14580
MNFGNIATAMVTPFDKNENIDFQKLSKLIDYLLNNGTDSLVVAGTTGESPTLSEEEKVALIQYSVKEAAGRAPIIAGTGSNNTKASIKLTKKAEEAGADAVMLVTPYYNKPSQEGMYRHFRAIAEETSLPVMLYNVPGRTAASLAPETTIRLAEIPNIIAIKEASGDLDAITKIVAETPEDFAVYSGDDSLTLPALSVGARGIVSVASHIIGPEMQEMIKHYTEGNTAQAALIHQKLLPLMKGLFAAPNPSPLKTALQLKGLDVGSVRLPLIPLNEDERLRLSSLMNGL

SEQ ID NO: 1504 - protein, 298 aa, Artificial
  Substituion in SEQ ID NO 1497
MRMDFGSLITAMVTPFDATGALDEGRLRRLVDHLIETGTTAVVVCGTTGESPTLSHAEKLRLFDATLRAVDGRIPVIAGTGTNSTKDSIELTLEAARLGVQAVMLVTPYYNRPSQEGLYMHFASIAESTTLPVMLYNVPGRTGVNLNPQTALQLAAIPNVVALKEASGDFSQILRIAAEKPDDFLLYSGDDKFTLPMLAIGAAGVVSVAGHVVGRQIRTMMDLFWQGQVDEAAYWSARLLPIFEAMFMEASPAPVKEALSILGIDVGSVRSPLVPASKALREHLYTLLNALGVIEPSA

SEQ ID NO: 1505 - protein, 298 aa, Artificial
  Substituion in SEQ ID NO 1497
MRMDFGSLITAMVTPFDATGALDEGRLRRLVDHLIETGTTAVVVCGTTGESPTLSHAEKLRLFDATLRAVDGRIPVIAGTGTNSTKDSIELTLEAARLGVQAVMLVTPYYNRPSQEGLYMHFASIAESTTLPVMLYNVPGRTGVNLQPQTALQLAAIPNVVALKEASGDFSQILRIAAEKPDDFLLYSGDDKFTLPMLAIGAAGVVSVAGHVVGRQIRTMMDLFWQGQVDEAAYWSARLLPIFEAMFMEASPAPVKEALSILGIDVGSVRSPLVPASKAIREHLYTLLNALGVIEPSA

SEQ ID NO: 1506 - protein, 298 aa, Artificial
  Substituion in SEQ ID NO 1497
MRMDFGSLITAMVTPFDATGALDEGRLRRLVDHLIETGTTAVVVCGTTGESPTLSHAEKLRLFDATLRAVDGRIPVIAGTGTNSTKDSIELTLEAARLGVQAVMLVTPYYNRPSQEGLYMHFASIAESTTLPVMLYNVPGRTGVNLQPQTALQLAAIPNVVALKEASGDFSQILRIAAEKPDDFLLYSGDDKFTLPMLAIGAAGVVSVAGHVVGRQIRTMMDLFWQGQVDDAAYWSARLLPIFEAMFMEASPAPVKEALSILGIDVGSVRSPLVPASKALREHLYTLLNALGVIEPSA

SEQ ID NO: 1507 - protein, 298 aa, Artificial
  Substituion in SEQ ID NO 1497
MRMDFGSLITAMVTPFDATGALDEGRLRRLVDHLIETGTTAVVVCGTTGESPTLSHAEKLRLFDATLRAVDGRIPVIAGTGTNSTKDSIELTLEAARLGVQAVMLVTPYYNRPSQEGLYMHFASIAESTTLPVMLYNVPGRTGVNLQPQTALQLAAIPNVVALKEASGDFSQILRIAAEKPDDFILYSGDDKFTLPMLAIGAAGVVSVAGHVVGRQIRTMMDLFWQGQVDEAAYWSARLLPIFEAMFMEASPAPVKEALSILGIDVGSVRSPLVPASKALREHLYTLLNALGVIEPSA

SEQ ID NO: 1508 - protein, 298 aa, Artificial
  Substituion in SEQ ID NO 1497
MRMDFGSLITAMVTPFDATGALDEGRLRRLVDHLIETGTTAVVVCGTTGESPTLSHAEKLKLFDATLRAVDGRIPVIAGTGTNSTKDSIELTLEAARLGVQAVMLVTPYYNRPSQEGLYMHFASIAESTTLPVMLYNVPGRTGVNLQPQTALQLAAIPNVVALKEASGDFSQILRIAAEKPDDFLLYSGDDKFTLPMLAIGAAGVVSVAGHVVGRQIRTMMDLFWQGQVDEAAYWSARLLPIFEAMFMEASPAPVKEALSILGIDVGSVRSPLVPASKALREHLYTLLNALGVIEPSA

SEQ ID NO: 1509 - DNA, 897 bp, Artificial
  Substituion in SEQ ID NO 1498
atgcgtatggattttggaagcctgatcacggcgatggtcacgccctttgatgccacgggtgcgctcgacgaggggcgcctgcggcggctggtggaccacctgatcgaaacgggcacgaccgcggtcgtggtgtgcgggacgacgggggaatccccaaccctgagccacgcggaaaagctgcgcctgttcgacgccaccctccgggcggtggacggccggattccggtgatcgcgggcacgggcaccaattcgaccaaggattccattgagctcacgctcgaggccgctcgtctcggcgtgcaggccgtcatgctcgtgacgccgtattacaaccgcccgtctcaggaagggctgtacatgcacttcgccagcatcgcggagtcgaccaccttgccggtcatgttgtacaacgtgccggggcggacgggggtcaatctgaatccgcagaccgcgcttcagctcgcggccatcccgaacgtcgtcgcgctcaaggaggcgagcggcgacttttcgcagatcctccgcatcgcggccgagaagccggacgactttcttctctacagcggggacgacaagttcacgttgccgatgctcgccatcggagcggcgggcgtcgtgagcgtcgcgggccacgtcgtcggtcggcagatccgcacgatgatggatctcttctggcaagggcaggtggacgaggcggcgtactggagcgcgcggctgttgcccatcttcgaggccatgtttatggaggccagcccggcgccggtgaaggaggcgctttccatcctcggcatcgacgtgggctccgtccgctcgccgcttgtgccggcctccaaggcgctccgcgagcacctgtacacgcttctgaacgcgctcggggtcatcgagccaagcgcatga

SEQ ID NO: 1510 - DNA, 897 bp, Artificial
  Substituion in SEQ ID NO 1498
atgcgtatggattttggaagcctgatcacggcgatggtcacgccctttgatgccacgggtgcgctcgacgaggggcgcctgcggcggctggtggaccacctgatcgaaacgggcacgaccgcggtcgtggtgtgcgggacgacgggggaatccccaaccctgagccacgcggaaaagctgcgcctgttcgacgccaccctccgggcggtggacggccggattccggtgatcgcgggcacgggcaccaattcgaccaaggattccattgagctcacgctcgaggccgctcgtctcggcgtgcaggccgtcatgctcgtgacgccgtattacaaccgcccgtctcaggaagggctgtacatgcacttcgccagcatcgcggagtcgaccaccttgccggtcatgttgtacaacgtgccggggcggacgggggtcaatctgcagccgcagaccgcgcttcagctcgcggccatcccgaacgtcgtcgcgctcaaggaggcgagcggcgacttttcgcagatcctccgcatcgcggccgagaagccggacgactttcttctctacagcggggacgacaagttcacgttgccgatgctcgccatcggagcggcgggcgtcgtgagcgtcgcgggccacgtcgtcggtcggcagatccgcacgatgatggatctcttctggcaagggcaggtggacgaggcggcgtactggagcgcgcggctgttgcccatcttcgaggccatgtttatggaggccagcccggcgccggtgaaggaggcgctttccatcctcggcatcgacgtgggctccgtccgctcgccgcttgtgccggcctccaaggcgattcgcgagcacctgtacacgcttctgaacgcgctcggggtcatcgagccaagcgcatga

SEQ ID NO: 1511 - DNA, 897 bp, Artificial
  Substituion in SEQ ID NO 1498
atgcgtatggattttggaagcctgatcacggcgatggtcacgccctttgatgccacgggtgcgctcgacgaggggcgcctgcggcggctggtggaccacctgatcgaaacgggcacgaccgcggtcgtggtgtgcgggacgacgggggaatccccaaccctgagccacgcggaaaagctgcgcctgttcgacgccaccctccgggcggtggacggccggattccggtgatcgcgggcacgggcaccaattcgaccaaggattccattgagctcacgctcgaggccgctcgtctcggcgtgcaggccgtcatgctcgtgacgccgtattacaaccgcccgtctcaggaagggctgtacatgcacttcgccagcatcgcggagtcgaccaccttgccggtcatgttgtacaacgtgccggggcggacgggggtcaatctgcagccgcagaccgcgcttcagctcgcggccatcccgaacgtcgtcgcgctcaaggaggcgagcggcgacttttcgcagatcctccgcatcgcggccgagaagccggacgactttcttctctacagcggggacgacaagttcacgttgccgatgctcgccatcggagcggcgggcgtcgtgagcgtcgcgggccacgtcgtcggtcggcagatccgcacgatgatggatctcttctggcaagggcaggtggacgatgcggcgtactggagcgcgcggctgttgcccatcttcgaggccatgtttatggaggccagcccggcgccggtgaaggaggcgctttccatcctcggcatcgacgtgggctccgtccgctcgccgcttgtgccggcctccaaggcgctccgcgagcacctgtacacgcttctgaacgcgctcggggtcatcgagccaagcgcatga

SEQ ID NO: 1512 - DNA, 897 bp, Artificial
  Substituion in SEQ ID NO 1498
atgcgtatggattttggaagcctgatcacggcgatggtcacgccctttgatgccacgggtgcgctcgacgaggggcgcctgcggcggctggtggaccacctgatcgaaacgggcacgaccgcggtcgtggtgtgcgggacgacgggggaatccccaaccctgagccacgcggaaaagctgcgcctgttcgacgccaccctccgggcggtggacggccggattccggtgatcgcgggcacgggcaccaattcgaccaaggattccattgagctcacgctcgaggccgctcgtctcggcgtgcaggccgtcatgctcgtgacgccgtattacaaccgcccgtctcaggaagggctgtacatgcacttcgccagcatcgcggagtcgaccaccttgccggtcatgttgtacaacgtgccggggcggacgggggtcaatctgcagccgcagaccgcgcttcagctcgcggccatcccgaacgtcgtcgcgctcaaggaggcgagcggcgacttttcgcagatcctccgcatcgcggccgagaagccggacgactttattctctacagcggggacgacaagttcacgttgccgatgctcgccatcggagcggcgggcgtcgtgagcgtcgcgggccacgtcgtcggtcggcagatccgcacgatgatggatctcttctggcaagggcaggtggacgaggcggcgtactggagcgcgcggctgttgcccatcttcgaggccatgtttatggaggccagcccggcgccggtgaaggaggcgctttccatcctcggcatcgacgtgggctccgtccgctcgccgcttgtgccggcctccaaggcgctccgcgagcacctgtacacgcttctgaacgcgctcggggtcatcgagccaagcgcatga

SEQ ID NO: 1513 - DNA, 897 bp, Artificial
  Substituion in SEQ ID NO 1498
atgcgtatggattttggaagcctgatcacggcgatggtcacgccctttgatgccacgggtgcgctcgacgaggggcgcctgcggcggctggtggaccacctgatcgaaacgggcacgaccgcggtcgtggtgtgcgggacgacgggggaatccccaaccctgagccacgcggaaaagctgaaactgttcgacgccaccctccgggcggtggacggccggattccggtgatcgcgggcacgggcaccaattcgaccaaggattccattgagctcacgctcgaggccgctcgtctcggcgtgcaggccgtcatgctcgtgacgccgtattacaaccgcccgtctcaggaagggctgtacatgcacttcgccagcatcgcggagtcgaccaccttgccggtcatgttgtacaacgtgccggggcggacgggggtcaatctgcagccgcagaccgcgcttcagctcgcggccatcccgaacgtcgtcgcgctcaaggaggcgagcggcgacttttcgcagatcctccgcatcgcggccgagaagccggacgactttcttctctacagcggggacgacaagttcacgttgccgatgctcgccatcggagcggcgggcgtcgtgagcgtcgcgggccacgtcgtcggtcggcagatccgcacgatgatggatctcttctggcaagggcaggtggacgaggcggcgtactggagcgcgcggctgttgcccatcttcgaggccatgtttatggaggccagcccggcgccggtgaaggaggcgctttccatcctcggcatcgacgtgggctccgtccgctcgccgcttgtgccggcctccaaggcgctccgcgagcacctgtacacgcttctgaacgcgctcggggtcatcgagccaagcgcatga

SEQ ID NO: 1514 - protein, 480 aa, Alicyclobacillus acidocaldarius
MRRLQNYVNGTWVEVESEHAVPVYNPATGEVIAETPLSTHVDVARAVEGAKRAFASWSRVPVVKRARVVFDFLAKLKAERDAIAKMITTEHGKSYLDAQAEVDRGIEGIEHALSAPTLMMGESLAEVSEGLEQTYYRYPLGVVASITPFNFPAMIPLWVMGWAVVTGNALILKPSEQTPMTTLRLVEMFHEAGLPPGVLQAVNGGKEAVDAILSHPEIVAVNFTGSTRTAAYVYETAARHHKRVQAFAGAKNHAIVLEDAVLEPTIDGILRAAFHNGGQRCMATSVVVAVGSVADEVVERLAEGARRMKIGHGFEEGVDVTPLIRKEHRDRVRAYVDEAAMSARLVVDGRPAIDEHPEGFYLGPCLLDGVTPEMRVWQEELFGPVLSVVRARDLDEAIAIANRSRYANGAILYTQSGKAAQVFRDRIDAGMVGINVNVPLPVAFFPFGGHKDSFYGVTGENGKELVQFFTRRKVVSTRWF

SEQ ID NO: 1515 - DNA, 1443 bp, Alicyclobacillus acidocaldarius
atgcgccgtctccaaaactatgtgaatggaacttgggtggaagttgagagcgaacacgccgtaccggtgtacaatcccgcgactggggaagtcatcgccgagacgccgctttcgacgcacgtcgatgtggcgcgggccgtggagggcgcgaagcgggcgtttgcgtcgtggagccgggtgcccgtcgtgaagcgggcccgggtggtgttcgacttcttggcgaagctgaaggcggagcgagacgccatcgccaagatgatcacgacggagcacggaaagagctacctggatgcgcaggccgaggtggatcgcggcatcgagggcatcgaacacgcgctgtccgcgcccacgctgatgatgggcgaatcgctcgccgaggtgtcggaggggctggagcagacgtactaccgctatcccttgggcgtggtcgccagcatcacgccgttcaactttccggccatgatccccttgtgggtgatggggtgggcggtcgtcaccggcaacgcgctgattttgaagccgtccgagcagacgccgatgaccacgcttcgcctggtggagatgttccacgaagcgggactgcccccgggcgtgcttcaggcggtcaacggcggcaaggaagccgtggacgccatcctgtcccatcccgagattgtcgccgtgaacttcacgggttcgacgaggacggccgcctatgtgtatgagacggctgcgcgccaccacaagcgggtgcaggcgttcgcgggtgcgaagaaccacgccattgtgctggaggacgccgtgctcgagccgaccatcgacggtatcctgcgcgccgcgttccacaacggcggccagcgctgcatggccacctccgtcgtcgtggccgtcggctcggtggcggatgaagtcgtcgagcggctggcggagggcgcgcggcgcatgaagattggccacggctttgaggaaggtgtcgacgtcacgccgctcattcggaaggaacatcgcgatcgcgtccgcgcgtacgtcgacgaggccgccatgtccgcccggctcgtggtggacggacggccagccatcgacgaacatcccgaagggttttatctcggcccgtgcctgctcgatggcgtgacgcccgagatgcgcgtctggcaggaggagttgttcggccccgtgctctccgtggtgcgggcgcgcgatctcgacgaggccatcgccatcgcgaatcgctcccgctacgcgaacggcgccatcctgtacacgcagagcggcaaggccgcacaggtgtttcgcgatcgaatcgacgcaggcatggtcggcatcaacgtcaacgtgcctctgcctgtggccttcttcccgttcggaggacacaaggactccttctacggcgtgacgggcgagaacggcaaggagctggttcagtttttcacgcgaaggaaggtcgtctcgacgcgttggttttga

SEQ ID NO: 1516 - protein, 481 aa, Bacillus cereus subsp. cytotoxis NVH 391-98
IKRVKNHINGEWVESTGTEVEAVPNPATGKIIAYVPLSPKEDVERAVEAAKNAYETWSKVPVPNRSRMLYKYLQLLQENKDELSKIITLENGKTLKDASGEVQRGIEAVELATSAPNLMMGQALPNIAGGIDGSIWRYPLGVVAGITPFNFPMMIPLWMFPLAIACGNTFVLKTSERTPLLAERLVELFYEAGFPKGVLNLVQGGKEVVNSILENKEIQAVSFVGSEPVARYVYETGTKYGKRVQALAGAKNHAIVMPDCNLEKTVQGVIGSAFGSSGERCMACSVVAVLDEIADEFIDALVSETRKLKVGDGFHEENYVGPLIRESHKERVIGYINSGVADGASLLVDGRQIKEDVEGGYFVGATIFDGVNQNMKIWQDEIFAPVLSIVRVRDLEEGIQLTNQSKFANGAVIYTSSGKHAQTFRDHIDAGMIGVNVNVPAPMAFFAFAGNKASFYGDLGTNGKDGVQFYTRKKVVTERWF

SEQ ID NO: 1517 - protein, 480 aa, Bacillus clausii KSM-K16
VKTVKNWIDGAWVEASTADTEVVPNPATGEAIAYVPLSGERDVEQAVASAKRAYETWKTVPVPERTRYMFAYLEQLKKNREQLAQLITLENGKTIKDARGEVQRGIECVELATSTPTMMMGDALPDIASGIDGSIWRYPLGVVAGITPFNFPMMVPLWMFPLAIAAGNTFVLKTSERTPLLAEQLVSLMHEVGLPRGVLNLVNGGKAVVNGLLNHPDVEAISFVGSEPVARYVYETGTANGKRVQALAGAKNHAVVLADCELDKTVQGVIGAAFASSGERCMACSVVAVVEEVADAFIEKLTAETKKLTVGNGKNDEHFVGPLIRQSHKDKVVKYIEQGVEQGAELLVDGRNATSEEAGYYLGATLFDHVTPEMTIWQEELFAPVLSIVRVRDLEEAIALTNRSRFANGAVIYTSSGKAAQHFRNAIDAGMVGINVNVPAPMAFFSFAGNKASFFGDLGTNGRDGIQFYTRKKVVTERWF

SEQ ID NO: 1518 - protein, 481 aa, Bacillus anthracis str. Ames
IKRVKNHINGEWVESTGTEVEAVPNPATGKIIAYVPLSPKEDVEKAVEAAKAAYETWSKVPVPNRSRQLYKYLQLLQENKEELAKIITLENGKTLTDATGEVQRGIEAVELATSAPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFHEDNYVGPLIRESHKERVLGYINSGVADGATLLVDGRKIKEEVGEGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLGTNGTDGVQFYTRKKVVTERWF

SEQ ID NO: 1519 - protein, 480 aa, Oceanobacillus iheyensis HTE831
KHMQNYINGKWVDAKSGKQEVIPNPATGETIATVTISDVEDVDMAVAAAKEVFPEWSDIPVPNRTRYLLDYWKLLQDNKEELAKIITLENGKSLRDAQGEVQRGIEVVELATSTPSMMMGDALPSIAKGIDGSIWRYPLGVVAGITPFNFPMMVPLWMFPLAIACGNTFVLKTSERTPILAERLVELFYEAGFPKGVLNLVHGGKEVVNRFLTHPDIEAVSFVGSEPVAKHVYQTGTAHGKRVQALAGAKNHAVVMPDCDVEKTIQGVLGAAFGSSGERCMACSVVAVVDDIADEFLEKLVKETKKLRVGDGMDDSNFIGPVIRESHKERVLSYIDSGVDEGAHLLVDGRKIKEETPDGYYVGATIFDHVTQDMKIWQDEIFAPVLSVVRVSDLEEGIRVTNQSKFANGAVIYTNSGKSAQQFRNRIDAGMIGVNVNVPAPMAFFSFAGNKASFYGDLGTNGKDGVQFYTRKKVVTERWF

SEQ ID NO: 1520 - protein, 481 aa, Bacillus cereus ATCC 14579
IKRVKNHINGEWVESTGTEVEAVPNPATGKIIAYVPLSPKEDVEKAVEAAKAAFETWSKVPVPNRSRNLYKYLQLLQENKDELAKIITLENGKTLTDATGEVQRGIEAVELATSTPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFNEDNYVGPLIRESHKERVLGYINSGVADGATLLVDGRKINEEVGEGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLSTNGTDGVQFYTRKKVVTERWF

SEQ ID NO: 1521 - protein, 480 aa, Artificial
  Substituion in SEQ ID NO 1514
MRRLQNYVNGTWVEVESEHAVPVYNPATGEVIAETPLSTHVDVARAVEGAKRAFASWSRVPVVKRARVVFDFLAKLKAERDAIAKMITTEHGKSYLDAQAEVDRGIEGIEHALSAPTLMMGESLAEVSEGLEQTYYRYPLGVVASITPFNFPAMIPLWVMGWAVVTGNALILKPSEQTPMTTLRLVEMFHEAGLPPGVLQAVNGGKEAVDAILSHPEIVAVNFTGSTRTAAYVYETAARHHKRVQAFAGAKNHAIVLEDAVLEPTIDGILRAAFHNGGQRCMATSVVVAVGSVADEVVERLAEGARRMKIGHGFEEGVDVTPLIRKEHRDRVRAYVDEAAMSARLVVDGRPAIDEHPEGFYLGPCLLDGVTPEMKVWQEELFGPVLSVVRARDLDEAIAIANRSRYANGAILYTQSGKAAQVFRDRIDAGMVGINVNVPLPVAFFPFGGHKDSFYGVTGENGKELVQFFTRRKVVSTRWF

SEQ ID NO: 1522 - protein, 480 aa, Artificial
  Substituion in SEQ ID NO 1514
MRRLQNYVNGTWVEVESEHAVPVYNPATGEVIAETPLSTHVDVARAVEGAKRAFASWSRVPVVKRARVVFDFLAKLKAERDAIAKMITTEHGKSYLDAQAEVDRGIEGIEHALSAPTLMMGESLAEVSEGLEQTYYRYPLGVVASITPFNFPAMIPLWVMGWAVVTGNALILKPSEQTPMTTLRLVEMFHEAGLPPGVLQAVNGGKEAVDAILSHPEIVAVNFTGSTRTAAYVYETAARHHKRVQAFAGAKNHAIVLEDAVLEPTIDGILRAAFHNGGQRCMATSVVVAVGSVADEVVERLAEGARRMKIGHGFEEGVEVTPLIRKEHRDRVRAYVDEAAMSARLVVDGRPAIDEHPEGFYLGPCLLDGVTPEMRVWQEELFGPVLSVVRARDLDEAIAIANRSRYANGAILYTQSGKAAQVFRDRIDAGMVGINVNVPLPVAFFPFGGHKDSFYGVTGENGKELVQFFTRRKVVSTRWF

SEQ ID NO: 1523 - protein, 480 aa, Artificial
  Substituion in SEQ ID NO 1514
MRRLQNYVNGTWVEVESEHAVPVYNPATGEVIAETPLSTHVDVARAVEGAKRAFASWSRVPVVKRARVVFDFLAKLKAERDAIAKMITTEHGKSYLDAQAEVDRGIEGIEHALSAPTLMMGESLAEVSEGLEQTYYRYPLGVVASITPFNFPAMIPLWVMGWAVVTGNALILKPSEQTPMTTLRLVEMFHEAGLPPGVLQAVNGGKEAVDAILSHPEIVAVNFTGSTRTAAYVYETAARHHKRVQAFAGAKNHAIVLEDAILEPTIDGILRAAFHNGGQRCMATSVVVAVGSVADEVVERLAEGARRMKIGHGFEEGVDVTPLIRKEHRDRVRAYVDEAAMSARLVVDGRPAIDEHPEGFYLGPCLLDGVTPEMRVWQEELFGPVLSVVRARDLDEAIAIANRSRYANGAILYTQSGKAAQVFRDRIDAGMVGINVNVPLPVAFFPFGGHKDSFYGVTGENGKELVQFFTRRKVVSTRWF

SEQ ID NO: 1524 - protein, 480 aa, Artificial
  Substituion in SEQ ID NO 1514
MRRLQNYVNGTWVEVESEHAVPVYNPATGEVIAETPLSTHVDVARAVEGAKRAFASWSRVPVVKRARVVFDFLAKLKAERDAIAKMITTEHGKSYLDAQAEVDRGIEGIEHALSAPTLMMGESLAEVSEGLEQTYYRYPLGVVASITPFNFPAMIPLWVMGWAVVTGNALILKPSEQTPMTTLRLVEMFHEAGLPPGVLQAVNGGKEAVDAILSHPEIVAVNFTGSTRTAAYVYETAARHHKRVQAFAGAKNHAIVLEDAVLEPTIDGILRAAFHNGGQRCMATSVVVAVGSVADEVVERLAEGARRMKIGHGFEEGVDVTPLIRKEHRDRVRAYVDEAAMSARLVVDGRPAIDEHPEGFYLGPCLLDGVTPEMRVWQEELFGPVLSVVRARDLDEAIAIANRSRYANGAILYTQSGKAAQVFRDKIDAGMVGINVNVPLPVAFFPFGGHKDSFYGVTGENGKELVQFFTRRKVVSTRWF

SEQ ID NO: 1525 - protein, 480 aa, Artificial
  Substituion in SEQ ID NO 1514
MRRLQNYVNGTWVEVESEHAVPVYNPATGEVIAETPLSTHVDVARAVEGAKKAFASWSRVPVVKRARVVFDFLAKLKAERDAIAKMITTEHGKSYLDAQAEVDRGIEGIEHALSAPTLMMGESLAEVSEGLEQTYYRYPLGVVASITPFNFPAMIPLWVMGWAVVTGNALILKPSEQTPMTTLRLVEMFHEAGLPPGVLQAVNGGKEAVDAILSHPEIVAVNFTGSTRTAAYVYETAARHHKRVQAFAGAKNHAIVLEDAVLEPTIDGILRAAFHNGGQRCMATSVVVAVGSVADEVVERLAEGARRMKIGHGFEEGVDVTPLIRKEHRDRVRAYVDEAAMSARLVVDGRPAIDEHPEGFYLGPCLLDGVTPEMRVWQEELFGPVLSVVRARDLDEAIAIANRSRYANGAILYTQSGKAAQVFRDRIDAGMVGINVNVPLPVAFFPFGGHKDSFYGVTGENGKELVQFFTRRKVVSTRWF

SEQ ID NO: 1526 - DNA, 1443 bp, Artificial
  Substituion in SEQ ID NO 1515
atgcgccgtctccaaaactatgtgaatggaacttgggtggaagttgagagcgaacacgccgtaccggtgtacaatcccgcgactggggaagtcatcgccgagacgccgctttcgacgcacgtcgatgtggcgcgggccgtggagggcgcgaagcgggcgtttgcgtcgtggagccgggtgcccgtcgtgaagcgggcccgggtggtgttcgacttcttggcgaagctgaaggcggagcgagacgccatcgccaagatgatcacgacggagcacggaaagagctacctggatgcgcaggccgaggtggatcgcggcatcgagggcatcgaacacgcgctgtccgcgcccacgctgatgatgggcgaatcgctcgccgaggtgtcggaggggctggagcagacgtactaccgctatcccttgggcgtggtcgccagcatcacgccgttcaactttccggccatgatccccttgtgggtgatggggtgggcggtcgtcaccggcaacgcgctgattttgaagccgtccgagcagacgccgatgaccacgcttcgcctggtggagatgttccacgaagcgggactgcccccgggcgtgcttcaggcggtcaacggcggcaaggaagccgtggacgccatcctgtcccatcccgagattgtcgccgtgaacttcacgggttcgacgaggacggccgcctatgtgtatgagacggctgcgcgccaccacaagcgggtgcaggcgttcgcgggtgcgaagaaccacgccattgtgctggaggacgccgtgctcgagccgaccatcgacggtatcctgcgcgccgcgttccacaacggcggccagcgctgcatggccacctccgtcgtcgtggccgtcggctcggtggcggatgaagtcgtcgagcggctggcggagggcgcgcggcgcatgaagattggccacggctttgaggaaggtgtcgacgtcacgccgctcattcggaaggaacatcgcgatcgcgtccgcgcgtacgtcgacgaggccgccatgtccgcccggctcgtggtggacggacggccagccatcgacgaacatcccgaagggttttatctcggcccgtgcctgctcgatggcgtgacgcccgagatgaaagtctggcaggaggagttgttcggccccgtgctctccgtggtgcgggcgcgcgatctcgacgaggccatcgccatcgcgaatcgctcccgctacgcgaacggcgccatcctgtacacgcagagcggcaaggccgcacaggtgtttcgcgatcgaatcgacgcaggcatggtcggcatcaacgtcaacgtgcctctgcctgtggccttcttcccgttcggaggacacaaggactccttctacggcgtgacgggcgagaacggcaaggagctggttcagtttttcacgcgaaggaaggtcgtctcgacgcgttggttttga

SEQ ID NO: 1527 - DNA, 1443 bp, Artificial
  Substituion in SEQ ID NO 1515
atgcgccgtctccaaaactatgtgaatggaacttgggtggaagttgagagcgaacacgccgtaccggtgtacaatcccgcgactggggaagtcatcgccgagacgccgctttcgacgcacgtcgatgtggcgcgggccgtggagggcgcgaagcgggcgtttgcgtcgtggagccgggtgcccgtcgtgaagcgggcccgggtggtgttcgacttcttggcgaagctgaaggcggagcgagacgccatcgccaagatgatcacgacggagcacggaaagagctacctggatgcgcaggccgaggtggatcgcggcatcgagggcatcgaacacgcgctgtccgcgcccacgctgatgatgggcgaatcgctcgccgaggtgtcggaggggctggagcagacgtactaccgctatcccttgggcgtggtcgccagcatcacgccgttcaactttccggccatgatccccttgtgggtgatggggtgggcggtcgtcaccggcaacgcgctgattttgaagccgtccgagcagacgccgatgaccacgcttcgcctggtggagatgttccacgaagcgggactgcccccgggcgtgcttcaggcggtcaacggcggcaaggaagccgtggacgccatcctgtcccatcccgagattgtcgccgtgaacttcacgggttcgacgaggacggccgcctatgtgtatgagacggctgcgcgccaccacaagcgggtgcaggcgttcgcgggtgcgaagaaccacgccattgtgctggaggacgccgtgctcgagccgaccatcgacggtatcctgcgcgccgcgttccacaacggcggccagcgctgcatggccacctccgtcgtcgtggccgtcggctcggtggcggatgaagtcgtcgagcggctggcggagggcgcgcggcgcatgaagattggccacggctttgaggaaggtgtcgaagtcacgccgctcattcggaaggaacatcgcgatcgcgtccgcgcgtacgtcgacgaggccgccatgtccgcccggctcgtggtggacggacggccagccatcgacgaacatcccgaagggttttatctcggcccgtgcctgctcgatggcgtgacgcccgagatgcgcgtctggcaggaggagttgttcggccccgtgctctccgtggtgcgggcgcgcgatctcgacgaggccatcgccatcgcgaatcgctcccgctacgcgaacggcgccatcctgtacacgcagagcggcaaggccgcacaggtgtttcgcgatcgaatcgacgcaggcatggtcggcatcaacgtcaacgtgcctctgcctgtggccttcttcccgttcggaggacacaaggactccttctacggcgtgacgggcgagaacggcaaggagctggttcagtttttcacgcgaaggaaggtcgtctcgacgcgttggttttga

SEQ ID NO: 1528 - DNA, 1443 bp, Artificial
  Substituion in SEQ ID NO 1515
atgcgccgtctccaaaactatgtgaatggaacttgggtggaagttgagagcgaacacgccgtaccggtgtacaatcccgcgactggggaagtcatcgccgagacgccgctttcgacgcacgtcgatgtggcgcgggccgtggagggcgcgaagcgggcgtttgcgtcgtggagccgggtgcccgtcgtgaagcgggcccgggtggtgttcgacttcttggcgaagctgaaggcggagcgagacgccatcgccaagatgatcacgacggagcacggaaagagctacctggatgcgcaggccgaggtggatcgcggcatcgagggcatcgaacacgcgctgtccgcgcccacgctgatgatgggcgaatcgctcgccgaggtgtcggaggggctggagcagacgtactaccgctatcccttgggcgtggtcgccagcatcacgccgttcaactttccggccatgatccccttgtgggtgatggggtgggcggtcgtcaccggcaacgcgctgattttgaagccgtccgagcagacgccgatgaccacgcttcgcctggtggagatgttccacgaagcgggactgcccccgggcgtgcttcaggcggtcaacggcggcaaggaagccgtggacgccatcctgtcccatcccgagattgtcgccgtgaacttcacgggttcgacgaggacggccgcctatgtgtatgagacggctgcgcgccaccacaagcgggtgcaggcgttcgcgggtgcgaagaaccacgccattgtgctggaggacgccattctcgagccgaccatcgacggtatcctgcgcgccgcgttccacaacggcggccagcgctgcatggccacctccgtcgtcgtggccgtcggctcggtggcggatgaagtcgtcgagcggctggcggagggcgcgcggcgcatgaagattggccacggctttgaggaaggtgtcgacgtcacgccgctcattcggaaggaacatcgcgatcgcgtccgcgcgtacgtcgacgaggccgccatgtccgcccggctcgtggtggacggacggccagccatcgacgaacatcccgaagggttttatctcggcccgtgcctgctcgatggcgtgacgcccgagatgcgcgtctggcaggaggagttgttcggccccgtgctctccgtggtgcgggcgcgcgatctcgacgaggccatcgccatcgcgaatcgctcccgctacgcgaacggcgccatcctgtacacgcagagcggcaaggccgcacaggtgtttcgcgatcgaatcgacgcaggcatggtcggcatcaacgtcaacgtgcctctgcctgtggccttcttcccgttcggaggacacaaggactccttctacggcgtgacgggcgagaacggcaaggagctggttcagtttttcacgcgaaggaaggtcgtctcgacgcgttggttttga

SEQ ID NO: 1529 - DNA, 1443 bp, Artificial
  Substituion in SEQ ID NO 1515
atgcgccgtctccaaaactatgtgaatggaacttgggtggaagttgagagcgaacacgccgtaccggtgtacaatcccgcgactggggaagtcatcgccgagacgccgctttcgacgcacgtcgatgtggcgcgggccgtggagggcgcgaagcgggcgtttgcgtcgtggagccgggtgcccgtcgtgaagcgggcccgggtggtgttcgacttcttggcgaagctgaaggcggagcgagacgccatcgccaagatgatcacgacggagcacggaaagagctacctggatgcgcaggccgaggtggatcgcggcatcgagggcatcgaacacgcgctgtccgcgcccacgctgatgatgggcgaatcgctcgccgaggtgtcggaggggctggagcagacgtactaccgctatcccttgggcgtggtcgccagcatcacgccgttcaactttccggccatgatccccttgtgggtgatggggtgggcggtcgtcaccggcaacgcgctgattttgaagccgtccgagcagacgccgatgaccacgcttcgcctggtggagatgttccacgaagcgggactgcccccgggcgtgcttcaggcggtcaacggcggcaaggaagccgtggacgccatcctgtcccatcccgagattgtcgccgtgaacttcacgggttcgacgaggacggccgcctatgtgtatgagacggctgcgcgccaccacaagcgggtgcaggcgttcgcgggtgcgaagaaccacgccattgtgctggaggacgccgtgctcgagccgaccatcgacggtatcctgcgcgccgcgttccacaacggcggccagcgctgcatggccacctccgtcgtcgtggccgtcggctcggtggcggatgaagtcgtcgagcggctggcggagggcgcgcggcgcatgaagattggccacggctttgaggaaggtgtcgacgtcacgccgctcattcggaaggaacatcgcgatcgcgtccgcgcgtacgtcgacgaggccgccatgtccgcccggctcgtggtggacggacggccagccatcgacgaacatcccgaagggttttatctcggcccgtgcctgctcgatggcgtgacgcccgagatgcgcgtctggcaggaggagttgttcggccccgtgctctccgtggtgcgggcgcgcgatctcgacgaggccatcgccatcgcgaatcgctcccgctacgcgaacggcgccatcctgtacacgcagagcggcaaggccgcacaggtgtttcgcgataaaatcgacgcaggcatggtcggcatcaacgtcaacgtgcctctgcctgtggccttcttcccgttcggaggacacaaggactccttctacggcgtgacgggcgagaacggcaaggagctggttcagtttttcacgcgaaggaaggtcgtctcgacgcgttggttttga

SEQ ID NO: 1530 - DNA, 1443 bp, Artificial
  Substituion in SEQ ID NO 1515
atgcgccgtctccaaaactatgtgaatggaacttgggtggaagttgagagcgaacacgccgtaccggtgtacaatcccgcgactggggaagtcatcgccgagacgccgctttcgacgcacgtcgatgtggcgcgggccgtggagggcgcgaagaaagcgtttgcgtcgtggagccgggtgcccgtcgtgaagcgggcccgggtggtgttcgacttcttggcgaagctgaaggcggagcgagacgccatcgccaagatgatcacgacggagcacggaaagagctacctggatgcgcaggccgaggtggatcgcggcatcgagggcatcgaacacgcgctgtccgcgcccacgctgatgatgggcgaatcgctcgccgaggtgtcggaggggctggagcagacgtactaccgctatcccttgggcgtggtcgccagcatcacgccgttcaactttccggccatgatccccttgtgggtgatggggtgggcggtcgtcaccggcaacgcgctgattttgaagccgtccgagcagacgccgatgaccacgcttcgcctggtggagatgttccacgaagcgggactgcccccgggcgtgcttcaggcggtcaacggcggcaaggaagccgtggacgccatcctgtcccatcccgagattgtcgccgtgaacttcacgggttcgacgaggacggccgcctatgtgtatgagacggctgcgcgccaccacaagcgggtgcaggcgttcgcgggtgcgaagaaccacgccattgtgctggaggacgccgtgctcgagccgaccatcgacggtatcctgcgcgccgcgttccacaacggcggccagcgctgcatggccacctccgtcgtcgtggccgtcggctcggtggcggatgaagtcgtcgagcggctggcggagggcgcgcggcgcatgaagattggccacggctttgaggaaggtgtcgacgtcacgccgctcattcggaaggaacatcgcgatcgcgtccgcgcgtacgtcgacgaggccgccatgtccgcccggctcgtggtggacggacggccagccatcgacgaacatcccgaagggttttatctcggcccgtgcctgctcgatggcgtgacgcccgagatgcgcgtctggcaggaggagttgttcggccccgtgctctccgtggtgcgggcgcgcgatctcgacgaggccatcgccatcgcgaatcgctcccgctacgcgaacggcgccatcctgtacacgcagagcggcaaggccgcacaggtgtttcgcgatcgaatcgacgcaggcatggtcggcatcaacgtcaacgtgcctctgcctgtggccttcttcccgttcggaggacacaaggactccttctacggcgtgacgggcgagaacggcaaggagctggttcagtttttcacgcgaaggaaggtcgtctcgacgcgttggttttga

SEQ ID NO: 1531 - protein, 548 aa, Alicyclobacillus acidocaldarius
MEPSQTAAFAELLAPDVFNIASAILDRDESRRALVWRSEAGAKRTLTYGELRRESLRLAQSLHDLGLRKGDRVLVLMPRRPETYAVYLAILSLGAVVLPGSELLMPNDIAYRLRHAEAKGVIAHAALAERAEAAIAEAPWVQLRVVVEGPREGWLAYDDLVRGAPREWDVVPTRRDDLAFLSYTSGTTGYPKGVMHVHGWAYAHWHIAAKRWLGIEPDDVVWATAGPGWAKWIWSPFVATLMSGATGFHYGGRFDAETFLRLIDDEAVNVLCATPTEYRMMAKVDGLDRFRLSSLRQAVSAGEPLNREVIDTFRRHFQVTVRDGYGQTENTLLVATCVDTEVRPGSMGLPTVEGAVDIVDDEGRPLPPGQVGDIAVRRDFPALFRGYYKDDERTEAQFRGAWYITGDRAEKDEDGYLWFSGRADDIIISAGYTIGPFEVEDALVKHPLVRECAAVSSPDEVRGAIVKAFVVLKDANLHRELASDGERREALVRELQEHVKRITAPYKYPRAIEFVEDLPKTTSGKIRRVELREREWKRHRKLNEEQGG

SEQ ID NO: 1532 - DNA, 1647 bp, Alicyclobacillus acidocaldarius
atggagccatcccaaaccgccgcatttgcggagcttctggcgccggacgtgttcaacatcgcgagcgccattctggaccgggacgaatcgaggcgcgcgctcgtgtggcgctcggaggccggggcgaagcggaccctgacgtacggcgagcttcgccgcgagtcccttcgcctggcgcaatctcttcacgatctcggccttcgaaaaggcgaccgggtcctggtgttgatgccgcgccgcccggagacctacgccgtgtatctcgccatcctctcgctcggcgccgtggttctgcccggatcggagttactcatgccgaacgacatcgcctatcgcctgagacacgcggaggcgaagggcgtgatcgcccacgcggcgctcgcggagcgggccgaggcggccatcgccgaggcgccgtgggtgcagttgcgcgtcgtggtcgagggcccgcgcgaaggctggctggcgtatgacgacctcgtgcgcggcgcccccagggagtgggacgtggttccgacgcgtcgggacgatctcgccttcctgtcgtacacctccgggacgacgggctaccccaagggtgtgatgcatgtccacggctgggcgtacgcgcactggcacatcgccgcgaagcgctggctcggcattgagcctgacgacgtggtgtgggccaccgccgggcccggatgggcgaagtggatctggagccccttcgtcgccacgctcatgtcgggcgccacaggcttccactacggtggccgatttgacgcggagacgtttcttcggctcatcgacgacgaagcggtcaatgtgctctgcgcgacgcccacggaataccggatgatggccaaggtggacggcctcgatcggtttcgcctctcgtcgctgcgccaggcggtgagcgcgggcgagcctcttaaccgagaagtcattgacacgttccgccgccattttcaggtcaccgtgcgcgacggctacgggcagacggagaacacgcttctcgttgcgacgtgcgtcgatacggaggtgcgccccggttcgatggggctgccgacggtcgaaggggccgtcgacattgtcgacgacgagggcaggccacttcctccgggccaggtgggggacatcgcggtcaggcgagacttcccggccctcttccggggttactacaaggacgacgagcggaccgaggctcagtttcggggcgcgtggtacatcacgggcgatcgcgccgagaaagacgaggacggatatctgtggttcagcggccgcgcggacgacatcatcatcagcgctggatacaccatcgggccgtttgaggtcgaggacgcgctcgtgaaacatccgctggtgcgcgagtgcgcagcggtgtcgagcccggatgaggtgcggggcgcaattgtgaaggcgttcgtcgtcctcaaggatgccaacttgcaccgagagctggcatccgacggcgagcgacgcgaggcgctggtgcgagaactgcaggagcacgtgaagcggatcaccgcgccctacaagtatccgcgcgcaattgagtttgtggaggatttgccgaagacgacgtcggggaagattcgccgcgtcgagctcagggagcgcgagtggaagcggcaccgcaagctgaacgaggagcagggagggtga

SEQ ID NO: 1533 - protein, 518 aa, Geobacillus kaustophilus HTA426
DLIAPERYNLTSEMERHAAADPDRIALKWESEQGETKEITYGRLMARANQIGNAFLSHGLEKGDKVLVMMPRLIETYEVYIGALKAGLVVIPSSEMLRTKDLQYRLVHSEAKAVVAYAPYTDEFAPIDGIERLTKFVIGEPRDGWIPLEDAMAKESETLEAADTSRDDMAFLSYTSGTTGNPKGVVHCHGWAYAHLRTAAKNWLCIEEGDLVWATAGPGWQKWIWSPFLSVLGSGATGFVYYGRFEPETYLQLLEKYNINVLCCTPTEYRLMAKVPDIGRYHLSHLHSAVSAGEPLNREVIDTFAKHFGVEVRDGYGQTENTLLVGVMKGMPIKPGSMGKPTPGNRVEIIDENGEPCPPGQVGDIAVHIETPALFKYYYKDPERTAMQFRGDYYITGDKARKDEDGYFWFEGRGDDIIISAGYTIGPFEVEDALVKHPAVKECAVVASPDEVRGHVVKAFVVLRDGVDKDDPSLIPALQEHVKQLTAPYKYPRKIEFVDDLPKTASGKIRRVELRERE

SEQ ID NO: 1534 - protein, 521 aa, Bacillus coagulans 36D1
SDLIAPQTYNIAEEIEKYARDPHKVALIWEDKEGMHREVTYKELIENANRTGHVFLESGLKKGDTILVMVPRIVEAYEVYLAAMKCGIVLLPASEMLRTKDLDYRIEAGDVKGVVAHYSCTEQFKEVRGIDHLKKFVIGEPEQGWAFLDEKKKAAPCELEIAKTSKDDIAILSYTSGTTGNPKGVIHTHSWGYAHLRTAAPNWLGIQKGDRVWATAAPGWQKWVWSPFLSVLGSGAIGFVYNGRFDPEKYLSLLDEYEINVLCCTPTEYRLMAKVDDLSQYHLKSLRSAVSAGEPLNREVIDVFQNHFGITIRDGYGQTESTLLVGYSLDTPLRPGSMGKPFPGNEVEIVNDDGKPCKLGETGDIAVHRDTPALFKGYYKEPERTAKQYRGDYFITGDRARKDEDGYFWFEGRRDDIIISSGYTIGPFEVEDALVKHPYVKECAVVASPHEIRGSIVKAFVVLKDGISENLPGLVKELQNHVKQLTAPYKYPRAIEFIKELPKTASGKIRRVELRQQEWNR

SEQ ID NO: 1535 - protein, 523 aa, Bacillus sp. SG-1
DLLSPERYNLISEVEKFAGEQGKKAIIWKSEQGEEKEITYENLIKNANKIGNAFINNGLEKGDVVLVMIPRLIEAYETYVAALKAGMVVIPSSEMLRAKDLKYRIEHGDVKAVVCYEPYTEQFDELEESSGLMKFVVGAEKEGWLSLDSLKNESSDELALADTGREDMAFLSYTSGTTGNPKGVVHTHGWAYAHLRTAAKKWLSIEEGDTVWATAGPGWQKWIWSPFLSVLGSGATGLVYQGKFEPDTYLQMLEDYQVNVLCCTPTEYRLMAKVDDLGKYHLQHLHSAVSAGEPLNREVIDAFQKHFNVDVRDGYGQTENTLLVGIMKGMELKPGSMGKPTPGNRVEIIDEDGKPCSPGEVGDIAVHVDTPALFKNYYKDPERTAMQFRGDYYITGDKAKKDEDGYFWFEGRGDDIIISSGYTIGPFEVEDALVKHPSVKECAVVASPDEVRGNIVKAFVVLRDGVSPEDPDLVKSLQDHVKELTAPYKYPRKIEFIEELPKTTSGKIRRIELRQNERKTVQK

SEQ ID NO: 1536 - protein, 524 aa, Bacillus cereus subsp. cytotoxis NVH 391-98
ELLAPPSYNLVTEIEKYMNEKDKLALIWQDEKGARREVTYFELIKGANKIGNAFIKSGLQKGDKLLIMMPRLIEAYMTYIGAIKAGFVVIPSSEMLRKKDIEYRIQHGEVKAIISYEPYISQFEGIEGMDSLQKFVLSEKEVDGWANLNTALETESDVLDIVKTDKEDMVFLSYTSGTTGNPKGVVHTHAWGYAHLRTSAPNWLGIEENDIVWATASPGWQKWIWSPFLATLGSGATGFVYHGKFEPKTYLQLLDENQVNVLCCTPTEYRLMAKVENLQQYNLKALHSAVSAGEPLNREVIETFQKHFQVTVRDGYGQTENTLLIGVMKGMEIRPGSMGKPTPGNQVEIINEEGHPVSVGEVGDIAVHIDTPALFKQYYKDDERTAMQFRGDYYITGDKAKKDEDGYFWFEGRGDDIIISSGYTIGPFEVEDALVKHPYVRECAVVASPDEIRGSVVKAFIVLRDNVQEKEDTLIPLLQEHVKTLTAPYKYPRKIEFVDELPKTISGKIRRVELRKQEMELRLK

SEQ ID NO: 1537 - protein, 518 aa, Bacillus thuringiensis serovar konkukian str. 97-27
ELLAPPSYNLVSEIEKYTGDKEKLALIWQDDKGNRREVTYAELMKGANKIGNAFIKSGLQKGDKLLIMMPRLIEAYMTYIAAIKAGFVVIPSSEMLRKKDIEYRIGHGEVKAIVSYEPYIGQFDDIEAMESLQKFVLSEQSVDGWINLKTALETESDMLEMAKTDKEDMVFLSYTSGTTGNPKGVVHTHAWAYAHLRTSAPNWLGIEENDVVWATASPGWQKWIWSPFLATLGSGATGFVYHGKFEPKTYLNLLDDNKVNVLCCTPTEYRLMAKVENLSEYNLEALHSAVSAGEPLNREVIETFQKHFHITVRDGYGQTENTLLVGVMKGMDIRPGSMGKPTPGNHVDIVDEEGMPVRVGEVGDIAVHIETPALFKQYYKDDERTAMQFRGDYYITGDKAKKDEDGYFWFEGRGDDIIISSGYTIGPFEVEDALVKHPYVRECAVVASPDEIRGSVVKAFIVLRENIEKNEETLIPILQQHVKELTAPYKYPRKIEFVDELPKTISGKIRRIELRKQE

SEQ ID NO: 1538 - protein, 548 aa, Artificial
  Substituion in SEQ ID NO 1531
MEPSQTAAFAELLAPDVFNIASAILDRDESRRALVWRSEAGAKRTLTYGELRRESLRLAQSLHDLGLRKGDRVLVLMPRRPETYAVYLAILSLGAVVLPGSELLMPNDIAYRLRHAEAKGVIAHAALAERAEAAIAEAPWVQLRVVVEGPREGWLAYDDLVRGAPREWDVVPTRRDDLAFLSYTSGTTGYPKGVMHVHGWAYAHWHIAAKRWLGIEPDDVVWATAGPGWAKWIWSPFVATLMSGATGFHYGGRFDAETFLRLIDDEAVNVLCATPTEYRMMAKVDGLERFRLSSLRQAVSAGEPLNREVIDTFRRHFQVTVRDGYGQTENTLLVATCVDTEVRPGSMGLPTVEGAVDIVDDEGRPLPPGQVGDIAVRRDFPALFRGYYKDDERTEAQFRGAWYITGDRAEKDEDGYLWFSGRADDIIISAGYTIGPFEVEDALVKHPLVRECAAVSSPDEVRGAIVKAFVVLKDANLHRELASDGERREALVRELQEHVKRITAPYKYPRAIEFVEDLPKTTSGKIRRVELREREWKRHRKLNEEQGG

SEQ ID NO: 1539 - protein, 548 aa, Artificial
  Substituion in SEQ ID NO 1531
MEPSQTAAFAELLAPDVFNIASAILDKDESRRALVWRSEAGAKRTLTYGELRRESLRLAQSLHDLGLRKGDRVLVLMPRRPETYAVYLAILSLGAVVLPGSELLMPNDIAYRLRHAEAKGVIAHAALAERAEAAIAEAPWVQLRVVVEGPREGWLAYDDLVRGAPREWDVVPTRRDDLAFLSYTSGTTGYPKGVMHVHGWAYAHWHIAAKRWLGIEPDDVVWATAGPGWAKWIWSPFVATLMSGATGFHYGGRFDAETFLRLIDDEAVNVLCATPTEYRMMAKVDGLDRFRLSSLRQAVSAGEPLNREVIDTFRRHFQVTVRDGYGQTENTLLVATCVDTEVRPGSMGLPTVEGAVDIVDDEGRPLPPGQVGDIAVRRDFPALFRGYYKDDERTEAQFRGAWYITGDRAEKDEDGYLWFSGRADDIIISAGYTIGPFEVEDALVKHPLVRECAAVSSPDEVRGAIVKAFVVLKDANLHRELASDGERREALVRELQEHVKRITAPYKYPRAIEFVEDLPKTTSGKIRRVELREREWKRHRKLNEEQGG

SEQ ID NO: 1540 - protein, 548 aa, Artificial
  Substituion in SEQ ID NO 1531
MEPSQTAAFAELLAPDVFNIASAILDRDESRRALVWRSEAGAKRTLTYGELRRESLRLAQSLHDLGLRKGDRVLVLMPRRPETYAVYLAILSLGAVVLPGSELLMPNDIAYRLRHAEAKGVIAHAALAERAEAAIAEAPWVQLRVVVEGPREGWLAYDDLVRGAPREWDVVPTRRDDLAFLSYTSGTTGYPKGVMHVHGWAYAHWHIAAKRWLGIEPDDVVWATAGPGWAKWIWSPFVATLMSGATGFHYGGRFDAETFLRLIDDEAVNVLCATPTEYRMMAKVDGLDRFRLSSLRQAVSAGEPLNREVIDTFRRHFQVTVRDGYGQTENTLLVATCVDTEVRPGSMGLPTVEGAVDIVDDEGRPLPPGQVGDIAVRRDFPALFRGYYKDDERTEAQFRGAWYITGDRAEKDEDGYLWFSGRADDIIISAGYTIGPFEVEDALVKHPLVRECAAVSSPDEVRGAIVKAFVVLKDANLHKELASDGERREALVRELQEHVKRITAPYKYPRAIEFVEDLPKTTSGKIRRVELREREWKRHRKLNEEQGG

SEQ ID NO: 1541 - protein, 548 aa, Artificial
  Substituion in SEQ ID NO 1531
MEPSQTAAFAELLAPDVFNIASAILDRDESRRALVWRSEAGAKRTLTYGELRRESLRLAQSLHDLGLRKGDRVLVLMPRRPETYAVYLAILSLGAVVLPGSELLMPNDIAYRLRHAEAKGVIAHAALAERAEAAIAEAPWVQLRVVVEGPREGWIAYDDLVRGAPREWDVVPTRRDDLAFLSYTSGTTGYPKGVMHVHGWAYAHWHIAAKRWLGIEPDDVVWATAGPGWAKWIWSPFVATLMSGATGFHYGGRFDAETFLRLIDDEAVNVLCATPTEYRMMAKVDGLDRFRLSSLRQAVSAGEPLNREVIDTFRRHFQVTVRDGYGQTENTLLVATCVDTEVRPGSMGLPTVEGAVDIVDDEGRPLPPGQVGDIAVRRDFPALFRGYYKDDERTEAQFRGAWYITGDRAEKDEDGYLWFSGRADDIIISAGYTIGPFEVEDALVKHPLVRECAAVSSPDEVRGAIVKAFVVLKDANLHRELASDGERREALVRELQEHVKRITAPYKYPRAIEFVEDLPKTTSGKIRRVELREREWKRHRKLNEEQGG

SEQ ID NO: 1542 - protein, 548 aa, Artificial
  Substituion in SEQ ID NO 1531
MEPSQTAAFAELLAPDVFNIASAILDRDESRRALVWRSEAGAKRTLTYGELRRESLRLAQSLHDLGLRKGDRVLVLMPRRPETYAVYLAILSLGAVVLPGSELLMPNDIAYRLRHAEAKGVIAHAALAERAEAAIAEAPWVQLRVVVEGPREGWLAYDDLVRGAPREWDVVPTRRDDLAFLSYTSGTTGYPKGVMHVHGWAYAHWHIAAKRWLGIEPDDVVWATAGPGWAKWIWSPFVATLMSGATGFHYGGRFDAETFLRLIDDEAVNVLCATPTEYRMMAKVDGLDRFRLSSLRQAVSAGEPLNREVIDTFRRHFQVTVRDGYGQTENTLLVATCVDTEVRPGSMGLPTVEGAVDIVDDEGRPLPPGQVGDIAVRRDFPALFRGYYKDDERTEAQFRGAWYITGDRAEKDEDGYLWFSGRADDIIISAGYTIGPFEVEDALVKHPLVRECAAVSSPDEVRGAIVKAFVVLKDANLHRELASDGERREALVRELQEHVKRITAPYKYPRAIEFVEDLPKTTSGKIRRVELREREWKRHRKLQEEQGG

SEQ ID NO: 1543 - DNA, 1647 bp, Artificial
  Substituion in SEQ ID NO 1532
atggagccatcccaaaccgccgcatttgcggagcttctggcgccggacgtgttcaacatcgcgagcgccattctggaccgggacgaatcgaggcgcgcgctcgtgtggcgctcggaggccggggcgaagcggaccctgacgtacggcgagcttcgccgcgagtcccttcgcctggcgcaatctcttcacgatctcggccttcgaaaaggcgaccgggtcctggtgttgatgccgcgccgcccggagacctacgccgtgtatctcgccatcctctcgctcggcgccgtggttctgcccggatcggagttactcatgccgaacgacatcgcctatcgcctgagacacgcggaggcgaagggcgtgatcgcccacgcggcgctcgcggagcgggccgaggcggccatcgccgaggcgccgtgggtgcagttgcgcgtcgtggtcgagggcccgcgcgaaggctggctggcgtatgacgacctcgtgcgcggcgcccccagggagtgggacgtggttccgacgcgtcgggacgatctcgccttcctgtcgtacacctccgggacgacgggctaccccaagggtgtgatgcatgtccacggctgggcgtacgcgcactggcacatcgccgcgaagcgctggctcggcattgagcctgacgacgtggtgtgggccaccgccgggcccggatgggcgaagtggatctggagccccttcgtcgccacgctcatgtcgggcgccacaggcttccactacggtggccgatttgacgcggagacgtttcttcggctcatcgacgacgaagcggtcaatgtgctctgcgcgacgcccacggaataccggatgatggccaaggtggacggcctcgaacggtttcgcctctcgtcgctgcgccaggcggtgagcgcgggcgagcctcttaaccgagaagtcattgacacgttccgccgccattttcaggtcaccgtgcgcgacggctacgggcagacggagaacacgcttctcgttgcgacgtgcgtcgatacggaggtgcgccccggttcgatggggctgccgacggtcgaaggggccgtcgacattgtcgacgacgagggcaggccacttcctccgggccaggtgggggacatcgcggtcaggcgagacttcccggccctcttccggggttactacaaggacgacgagcggaccgaggctcagtttcggggcgcgtggtacatcacgggcgatcgcgccgagaaagacgaggacggatatctgtggttcagcggccgcgcggacgacatcatcatcagcgctggatacaccatcgggccgtttgaggtcgaggacgcgctcgtgaaacatccgctggtgcgcgagtgcgcagcggtgtcgagcccggatgaggtgcggggcgcaattgtgaaggcgttcgtcgtcctcaaggatgccaacttgcaccgagagctggcatccgacggcgagcgacgcgaggcgctggtgcgagaactgcaggagcacgtgaagcggatcaccgcgccctacaagtatccgcgcgcaattgagtttgtggaggatttgccgaagacgacgtcggggaagattcgccgcgtcgagctcagggagcgcgagtggaagcggcaccgcaagctgaacgaggagcagggagggtga

SEQ ID NO: 1544 - DNA, 1647 bp, Artificial
  Substituion in SEQ ID NO 1532
atggagccatcccaaaccgccgcatttgcggagcttctggcgccggacgtgttcaacatcgcgagcgccattctggacaaagacgaatcgaggcgcgcgctcgtgtggcgctcggaggccggggcgaagcggaccctgacgtacggcgagcttcgccgcgagtcccttcgcctggcgcaatctcttcacgatctcggccttcgaaaaggcgaccgggtcctggtgttgatgccgcgccgcccggagacctacgccgtgtatctcgccatcctctcgctcggcgccgtggttctgcccggatcggagttactcatgccgaacgacatcgcctatcgcctgagacacgcggaggcgaagggcgtgatcgcccacgcggcgctcgcggagcgggccgaggcggccatcgccgaggcgccgtgggtgcagttgcgcgtcgtggtcgagggcccgcgcgaaggctggctggcgtatgacgacctcgtgcgcggcgcccccagggagtgggacgtggttccgacgcgtcgggacgatctcgccttcctgtcgtacacctccgggacgacgggctaccccaagggtgtgatgcatgtccacggctgggcgtacgcgcactggcacatcgccgcgaagcgctggctcggcattgagcctgacgacgtggtgtgggccaccgccgggcccggatgggcgaagtggatctggagccccttcgtcgccacgctcatgtcgggcgccacaggcttccactacggtggccgatttgacgcggagacgtttcttcggctcatcgacgacgaagcggtcaatgtgctctgcgcgacgcccacggaataccggatgatggccaaggtggacggcctcgatcggtttcgcctctcgtcgctgcgccaggcggtgagcgcgggcgagcctcttaaccgagaagtcattgacacgttccgccgccattttcaggtcaccgtgcgcgacggctacgggcagacggagaacacgcttctcgttgcgacgtgcgtcgatacggaggtgcgccccggttcgatggggctgccgacggtcgaaggggccgtcgacattgtcgacgacgagggcaggccacttcctccgggccaggtgggggacatcgcggtcaggcgagacttcccggccctcttccggggttactacaaggacgacgagcggaccgaggctcagtttcggggcgcgtggtacatcacgggcgatcgcgccgagaaagacgaggacggatatctgtggttcagcggccgcgcggacgacatcatcatcagcgctggatacaccatcgggccgtttgaggtcgaggacgcgctcgtgaaacatccgctggtgcgcgagtgcgcagcggtgtcgagcccggatgaggtgcggggcgcaattgtgaaggcgttcgtcgtcctcaaggatgccaacttgcaccgagagctggcatccgacggcgagcgacgcgaggcgctggtgcgagaactgcaggagcacgtgaagcggatcaccgcgccctacaagtatccgcgcgcaattgagtttgtggaggatttgccgaagacgacgtcggggaagattcgccgcgtcgagctcagggagcgcgagtggaagcggcaccgcaagctgaacgaggagcagggagggtga

SEQ ID NO: 1545 - DNA, 1647 bp, Artificial
  Substituion in SEQ ID NO 1532
atggagccatcccaaaccgccgcatttgcggagcttctggcgccggacgtgttcaacatcgcgagcgccattctggaccgggacgaatcgaggcgcgcgctcgtgtggcgctcggaggccggggcgaagcggaccctgacgtacggcgagcttcgccgcgagtcccttcgcctggcgcaatctcttcacgatctcggccttcgaaaaggcgaccgggtcctggtgttgatgccgcgccgcccggagacctacgccgtgtatctcgccatcctctcgctcggcgccgtggttctgcccggatcggagttactcatgccgaacgacatcgcctatcgcctgagacacgcggaggcgaagggcgtgatcgcccacgcggcgctcgcggagcgggccgaggcggccatcgccgaggcgccgtgggtgcagttgcgcgtcgtggtcgagggcccgcgcgaaggctggctggcgtatgacgacctcgtgcgcggcgcccccagggagtgggacgtggttccgacgcgtcgggacgatctcgccttcctgtcgtacacctccgggacgacgggctaccccaagggtgtgatgcatgtccacggctgggcgtacgcgcactggcacatcgccgcgaagcgctggctcggcattgagcctgacgacgtggtgtgggccaccgccgggcccggatgggcgaagtggatctggagccccttcgtcgccacgctcatgtcgggcgccacaggcttccactacggtggccgatttgacgcggagacgtttcttcggctcatcgacgacgaagcggtcaatgtgctctgcgcgacgcccacggaataccggatgatggccaaggtggacggcctcgatcggtttcgcctctcgtcgctgcgccaggcggtgagcgcgggcgagcctcttaaccgagaagtcattgacacgttccgccgccattttcaggtcaccgtgcgcgacggctacgggcagacggagaacacgcttctcgttgcgacgtgcgtcgatacggaggtgcgccccggttcgatggggctgccgacggtcgaaggggccgtcgacattgtcgacgacgagggcaggccacttcctccgggccaggtgggggacatcgcggtcaggcgagacttcccggccctcttccggggttactacaaggacgacgagcggaccgaggctcagtttcggggcgcgtggtacatcacgggcgatcgcgccgagaaagacgaggacggatatctgtggttcagcggccgcgcggacgacatcatcatcagcgctggatacaccatcgggccgtttgaggtcgaggacgcgctcgtgaaacatccgctggtgcgcgagtgcgcagcggtgtcgagcccggatgaggtgcggggcgcaattgtgaaggcgttcgtcgtcctcaaggatgccaacttgcacaaagagctggcatccgacggcgagcgacgcgaggcgctggtgcgagaactgcaggagcacgtgaagcggatcaccgcgccctacaagtatccgcgcgcaattgagtttgtggaggatttgccgaagacgacgtcggggaagattcgccgcgtcgagctcagggagcgcgagtggaagcggcaccgcaagctgaacgaggagcagggagggtga

SEQ ID NO: 1546 - DNA, 1647 bp, Artificial
  Substituion in SEQ ID NO 1532
atggagccatcccaaaccgccgcatttgcggagcttctggcgccggacgtgttcaacatcgcgagcgccattctggaccgggacgaatcgaggcgcgcgctcgtgtggcgctcggaggccggggcgaagcggaccctgacgtacggcgagcttcgccgcgagtcccttcgcctggcgcaatctcttcacgatctcggccttcgaaaaggcgaccgggtcctggtgttgatgccgcgccgcccggagacctacgccgtgtatctcgccatcctctcgctcggcgccgtggttctgcccggatcggagttactcatgccgaacgacatcgcctatcgcctgagacacgcggaggcgaagggcgtgatcgcccacgcggcgctcgcggagcgggccgaggcggccatcgccgaggcgccgtgggtgcagttgcgcgtcgtggtcgagggcccgcgcgaaggctggattgcgtatgacgacctcgtgcgcggcgcccccagggagtgggacgtggttccgacgcgtcgggacgatctcgccttcctgtcgtacacctccgggacgacgggctaccccaagggtgtgatgcatgtccacggctgggcgtacgcgcactggcacatcgccgcgaagcgctggctcggcattgagcctgacgacgtggtgtgggccaccgccgggcccggatgggcgaagtggatctggagccccttcgtcgccacgctcatgtcgggcgccacaggcttccactacggtggccgatttgacgcggagacgtttcttcggctcatcgacgacgaagcggtcaatgtgctctgcgcgacgcccacggaataccggatgatggccaaggtggacggcctcgatcggtttcgcctctcgtcgctgcgccaggcggtgagcgcgggcgagcctcttaaccgagaagtcattgacacgttccgccgccattttcaggtcaccgtgcgcgacggctacgggcagacggagaacacgcttctcgttgcgacgtgcgtcgatacggaggtgcgccccggttcgatggggctgccgacggtcgaaggggccgtcgacattgtcgacgacgagggcaggccacttcctccgggccaggtgggggacatcgcggtcaggcgagacttcccggccctcttccggggttactacaaggacgacgagcggaccgaggctcagtttcggggcgcgtggtacatcacgggcgatcgcgccgagaaagacgaggacggatatctgtggttcagcggccgcgcggacgacatcatcatcagcgctggatacaccatcgggccgtttgaggtcgaggacgcgctcgtgaaacatccgctggtgcgcgagtgcgcagcggtgtcgagcccggatgaggtgcggggcgcaattgtgaaggcgttcgtcgtcctcaaggatgccaacttgcaccgagagctggcatccgacggcgagcgacgcgaggcgctggtgcgagaactgcaggagcacgtgaagcggatcaccgcgccctacaagtatccgcgcgcaattgagtttgtggaggatttgccgaagacgacgtcggggaagattcgccgcgtcgagctcagggagcgcgagtggaagcggcaccgcaagctgaacgaggagcagggagggtga

SEQ ID NO: 1547 - DNA, 1647 bp, Artificial
  Substituion in SEQ ID NO 1532
atggagccatcccaaaccgccgcatttgcggagcttctggcgccggacgtgttcaacatcgcgagcgccattctggaccgggacgaatcgaggcgcgcgctcgtgtggcgctcggaggccggggcgaagcggaccctgacgtacggcgagcttcgccgcgagtcccttcgcctggcgcaatctcttcacgatctcggccttcgaaaaggcgaccgggtcctggtgttgatgccgcgccgcccggagacctacgccgtgtatctcgccatcctctcgctcggcgccgtggttctgcccggatcggagttactcatgccgaacgacatcgcctatcgcctgagacacgcggaggcgaagggcgtgatcgcccacgcggcgctcgcggagcgggccgaggcggccatcgccgaggcgccgtgggtgcagttgcgcgtcgtggtcgagggcccgcgcgaaggctggctggcgtatgacgacctcgtgcgcggcgcccccagggagtgggacgtggttccgacgcgtcgggacgatctcgccttcctgtcgtacacctccgggacgacgggctaccccaagggtgtgatgcatgtccacggctgggcgtacgcgcactggcacatcgccgcgaagcgctggctcggcattgagcctgacgacgtggtgtgggccaccgccgggcccggatgggcgaagtggatctggagccccttcgtcgccacgctcatgtcgggcgccacaggcttccactacggtggccgatttgacgcggagacgtttcttcggctcatcgacgacgaagcggtcaatgtgctctgcgcgacgcccacggaataccggatgatggccaaggtggacggcctcgatcggtttcgcctctcgtcgctgcgccaggcggtgagcgcgggcgagcctcttaaccgagaagtcattgacacgttccgccgccattttcaggtcaccgtgcgcgacggctacgggcagacggagaacacgcttctcgttgcgacgtgcgtcgatacggaggtgcgccccggttcgatggggctgccgacggtcgaaggggccgtcgacattgtcgacgacgagggcaggccacttcctccgggccaggtgggggacatcgcggtcaggcgagacttcccggccctcttccggggttactacaaggacgacgagcggaccgaggctcagtttcggggcgcgtggtacatcacgggcgatcgcgccgagaaagacgaggacggatatctgtggttcagcggccgcgcggacgacatcatcatcagcgctggatacaccatcgggccgtttgaggtcgaggacgcgctcgtgaaacatccgctggtgcgcgagtgcgcagcggtgtcgagcccggatgaggtgcggggcgcaattgtgaaggcgttcgtcgtcctcaaggatgccaacttgcaccgagagctggcatccgacggcgagcgacgcgaggcgctggtgcgagaactgcaggagcacgtgaagcggatcaccgcgccctacaagtatccgcgcgcaattgagtttgtggaggatttgccgaagacgacgtcggggaagattcgccgcgtcgagctcagggagcgcgagtggaagcggcaccgcaagctgcaagaggagcagggagggtga

SEQ ID NO: 1548 - protein, 499 aa, Alicyclobacillus acidocaldarius
MRRMHRFEPCLNFIGGRWREPKTGQYGDNVNPANGEVLGVWARSGPDDLDDAVRAAREAQAAWRLVPAPERAKVLRRVADLLRDRKDEIARTLTMEMGKVIEEARGEVQEAIDMAEYMAGEGRRLFGQTTPSELPDKFAMSVRVPVGVVGIITPWNFPIAIASWKSLPAIVAGNAVVWKPAEETPLTARAFVEVYQEAGLPAGVLNVVFGDGPVVGEAMLHHPGIDVISFTGSTETGRHIASRAGANLKRVSLEMGGKNAITVLADADLDLAVDAILWSAYGTSGQRCTAASRVIVEREAEEALLARLLPRVQALRVGDGLDPAVNVGPVIHEEALAKIDRYVRLGVDEGARLLTGGRRLTEGPLARGFYYAPTVFAGVRPDMRIAQEEIFGPVLCVMAVDSFEEAIRVNNGVRYGLSASIFTRDVNRVFRAMRDLDTGIVYVNAGTTGAEIHLPFGGTKATGNGHRDSGQAALDVFTEWKTVYVDYSGRLQRAQIDNN

SEQ ID NO: 1549 - DNA, 1500 bp, Alicyclobacillus acidocaldarius
gtgaggcgcatgcatcggtttgagccttgtctgaatttcatcggcggcaggtggcgcgagcccaagacggggcagtacggggacaacgtcaaccccgcaaacggcgaggtgctcggggtgtgggcgagatcgggcccggacgatctcgacgacgccgtgcgggcggcccgcgaggcgcaggccgcgtggcgcctggtgcccgctccggagcgcgcgaaggtgctgcggcgcgtcgcggatctgctgcgggatcgcaaggacgagatcgcgcggacgctgacaatggagatgggcaaggtcatcgaggaggcgcgcggcgaggtgcaggaggccatcgacatggccgagtacatggcgggcgaggggcgaaggctgttcggccagacgacgccctcggaacttcccgacaagttcgccatgagcgtgcgcgttccggtgggcgtggtggggatcatcacgccgtggaacttccccatcgccatcgcgtcgtggaagtcgcttccggccatcgtcgccggcaacgccgtggtgtggaagcccgcggaggagacaccgctcaccgcgcgggcgttcgtggaggtgtatcaggaggccgggctgcctgcgggcgttctgaacgtggtgttcggcgatggccccgtggtcggcgaggcgatgctccatcaccccgggatcgacgtcatctccttcaccggatcgacggagacggggcggcacatcgcgagccgtgcgggtgcgaatctgaagcgcgtgtccctcgagatgggcggcaaaaacgccatcacggtgctcgccgacgcggacctggacctcgccgtggacgccatcctctggagtgcctacggcacgagcggccagcggtgcaccgcggcgagccgcgtgatcgtggagcgcgaggcggaggaagcgttgctcgctcgcttgctgccgcgcgtgcaggcgctccgcgtcggcgacgggctggatccggccgtcaacgtcgggcccgtcatccacgaggaagccctcgcgaagatcgaccggtacgtgcggctcggcgtggacgagggtgcgcggctcttgactggcggccgcaggctgacggagggcccgctggcgcgcggcttttactatgcgccgaccgtgttcgccggcgtccgccccgacatgcgcatcgcgcaggaggagatcttcggcccggtgctctgcgtgatggccgtcgactcgttcgaggaagccatccgcgtcaacaacggggttcgctacgggctctcggccagcatcttcacgcgcgacgtcaaccgcgtgtttcgcgccatgcgcgatctcgacaccgggatcgtgtacgtcaacgcgggcacgacgggcgccgaaattcacctgccgttcggcggtaccaaggccaccggaaacgggcaccgagattccggccaggccgccttggacgtcttcacggagtggaagaccgtgtacgtcgattacagcggccggctgcagcgcgcgcagatcgacaacaactga

SEQ ID NO: 1550 - protein, 488 aa, Geobacillus kaustophilus HTA426
NYINGEWKEPSTGQFAPVINPATGETIAEVAMSGPNDIDEAVQAAKEAQKQWALVPAPKRAEILYKVGMLLKERKEQLARMLTMEMGKVIEEARGEVQEGIDMAFYMAGEGRRLFGDTTPSELKDKFAMSVRVPVGVVGIITPWNFPIAIATWKSFPAIVAGNAVVWKPAPETPIMAQELARIFEEAGLPPGVFHVVHGDGPTVGNALVEHPDVKVISFTGSNEVGRMIAEKCGRLLKKVSLEMGGKNAVIVMDDADLTLAVDGIIWSAFGTSGQRCTACSRVIVHERVKQELERRLLEAVKTLKIGNGLDETVKVGPVIHEEALQKIDRYVRIGVEEGAKLLVGGYILREGDYARGFYYAPTIFTDVTPNMRIAREEIFGPVVSIISVRSLDEAIAVNNSVDYGLSSAIFTRDVNNVFRAMRDLDTGIVYVNAGTTGAEIHLPFGGTKGTGNGHRDSGVAALDVFTEWRSIYVDFSGKLQRAQIDTD

SEQ ID NO: 1551 - protein, 489 aa, Geobacillus thermodenitrificans NG80-2
LNFINGKWQPALSGQWAPVINPANGETIGEVALSAAADVDAAVKAAKAAQKKWALVPAPKRADVLYKVGLLLKERKEQLARLLTMEMGKVIEEARGEVQEGIDMAFYMAGEGRRLFGDTTPSELKDKFAMSVRVPVGVVGIITPWNFPIAIATWKSFPAIVAGNAVVWKPALETPFMARELAAIFTEAGLPDGVFNVVHGDGPTAGNALVEHPDVPVISFTGSNEVGRQIAEKCGRLLKKVSLEMGGKNAVIVMDDADLTLAVDGIVWSAFGTSGQRCTACSRVIVHERVKQELEWRLLEAVKTLKIGDGLDETVKVGPVIHEEALQKIERYVHIGREEGAKLLVGGHILSDGDYARGFYYAPTIFTDVTPDMRIAREEIFGPVVSIISVRSLDEAIAVNNCVDYGLSSAIFTRDVNNVFRAMRDLDTGIVYVNAGTTGAEIHLPFGGTKGTGNGHRDSGVAALDVFTEWRSIYVDFSGKLQRAQIDTD

SEQ ID NO: 1552 - protein, 488 aa, Bacillus coagulans 36D1
EKYLNYIDGEWCEPSTGKFAPVVNPANGKTLGEVAQSAEPDLDRAVQAAKSAQSVWRLVPAPERANYLYKVGELLKQRKEQIARTLTSEMGKVIDEARGEVQEAIDMAFYMAGEGRRQFGDTVPSELQNKFAMSIRVPVGIAGLITPWNFPIAIASWKSLPALVTGNAVIWKPATETPATACAFVKIYEEAGLPKGLVNLVHGSGSVIGEAMVEHPGIGLISFTGSNEVGRKINERAGGLLKRTSLEMGGKNAVIVMDDADLDLAVDGILWGAFGTSGQRCTATSRVIVHKKIKDALEEKLIRRTAELKIGDGLDETVAVGPVINTEALNRIHQYVETGKKEGARLLTGGRILPGKGYYYAPTVFTDVSPEMVIAQEEIFGPVVSIIPVASLEEAIVVNNSVTFGLSSGIFTKDVNKAFQAMRDLDTGIVYINAGTTGAEIHLPFGGTKGTGNGHRDSGPAALDVYTEWKAVYVDFSGKLQRAQIDNN

SEQ ID NO: 1553 - protein, 456 aa, Geobacillus stearothermophilus
SGPNDIDEAVQAAKEAQRQWALVPAPKRAEILYKVGMLLKERKEQLARLLTMEMGKVIEEARGEVQEGIDMAFYMAGEGRRLFGDTTPSELKDKFAMSVRTPVGVVGIITPWNFPIAIATWKSFPAIVAGNAVVWKPAPETPIMAQELARIFEEAGLPPGVFHVVHGDGPTVGNALVEHPDVKVISFTGSNEVGRMIAEKCGRLLKKVSLEMGGKNAVIVMDDADLTLAVDGIIWSAFGTSGQRCTACSRVIVHERVKQEFERRLLEAVKTLKIGNGLDETVKVGPVIHEEALQKIDRYVRIGVEEGAKLLVGGYILREGDYARGFYYAPTIFTDVTPNMRIAREEIFGPVVSIISVRSLDEAIAVNNSVDYGLSSAIFTRDVNNVFRAMRDLDTGIVYVNAGTTGAEIHLPFGGTKGTGNGHRDSGVAALDVFTEWRSIYVDFSGKLQRAQIDTD

SEQ ID NO: 1554 - protein, 486 aa, Bacillus sp. B14905
NYIGGKWSTHSHLQSIAVTNPANGEQLATIPLSTSNEVDEAVVAAKQAQKSWALVPAPKRAEFLYAIGQKMKEKKEYLATVLTKEMGKVIEEARGEVQEGIDMAYYMAGEGRRLFGETTPSELANKFAMSVRAPIGVVALITPWNFPVAIATWKSFPAIVAGNTFIWKPSNETPMMACEMGKIFEEVGLPDGVANIVFGTGPTVGTALIEHPDVKVISFTGSTTTGSKVAELGGKHLKKISLEMGGKNAVIVMDDADLQLATEGILWSAFGTAGQRCTACSRVIVHKDVKEQLENRLLDEMQKLTIGNGLDEGVKIGPVINKAALEKINHYVQIGKQEGATLLAGGRILNEPPYDNGFYYEPTLFTNVKPDMIIAQEEIFGPVVSLIEVASLEEAIEVNNGVKFGLSSSIFSQNVNTIFRAQRDLDTGIVYINAGTTGAEIHLPFGGTKGTGNGHRDSGVAALDVYTEWKSIYVDYSGKLQRAQID

SEQ ID NO: 1555 - protein, 499 aa, Artificial
  Substituion in SEQ ID NO 1548
MRRMHRFEPCLNFIGGRWREPKTGQYGDNVNPANGEVLGVWARSGPDDLDDAVRAAREAQAAWRLVPAPERAKVLRRVADLLRDRKDEIARTLTMEMGKVIEEARGEVQEAIDMAEYMAGEGRRLFGQTTPSELPDKFAMSVRVPVGVVGIITPWNFPIAIASWKSLPAIVAGNAVVWKPAEETPLTARAFVEVYQEAGLPAGVLNVVFGDGPVVGEAMLHHPGIDVISFTGSTETGRHIASRAGANLKRVSLEMGGKNAITVLADADLDLAVDAILWSAYGTSGQRCTAASRVIVEREAEEALLARLLPRVQALRVGDGLDPAVNVGPVIHEEALAKIDRYVRIGVDEGARLLTGGRRLTEGPLARGFYYAPTVFAGVRPDMRIAQEEIFGPVLCVMAVDSFEEAIRVNNGVRYGLSASIFTRDVNRVFRAMRDLDTGIVYVNAGTTGAEIHLPFGGTKATGNGHRDSGQAALDVFTEWKTVYVDYSGRLQRAQIDNN

SEQ ID NO: 1556 - protein, 499 aa, Artificial
  Substituion in SEQ ID NO 1548
MRRMHRFEPCLNFIGGRWREPKTGQYGDNVNPANGEVLGVWARSGPDDLDDAVRAAREAQAAWRLVPAPERAKVLRRVADLLRDRKDEIARTLTMEMGKVIEEARGEVQEAIDMAEYMAGEGRRIFGQTTPSELPDKFAMSVRVPVGVVGIITPWNFPIAIASWKSLPAIVAGNAVVWKPAEETPLTARAFVEVYQEAGLPAGVLNVVFGDGPVVGEAMLHHPGIDVISFTGSTETGRHIASRAGANLKRVSLEMGGKNAITVLADADLDLAVDAILWSAYGTSGQRCTAASRVIVEREAEEALLARLLPRVQALRVGDGLDPAVNVGPVIHEEALAKIDRYVRLGVDEGARLLTGGRRLTEGPLARGFYYAPTVFAGVRPDMRIAQEEIFGPVLCVMAVDSFEEAIRVNNGVRYGLSASIFTRDVNRVFRAMRDLDTGIVYVNAGTTGAEIHLPFGGTKATGNGHRDSGQAALDVFTEWKTVYVDYSGRLQRAQIDNN

SEQ ID NO: 1557 - protein, 499 aa, Artificial
  Substituion in SEQ ID NO 1548
MRRMHRFEPCLNFIGGRWREPKTGQYGDNVNPANGEVLGVWARSGPDDLDDAVRAAREAQAAWKLVPAPERAKVLRRVADLLRDRKDEIARTLTMEMGKVIEEARGEVQEAIDMAEYMAGEGRRLFGQTTPSELPDKFAMSVRVPVGVVGIITPWNFPIAIASWKSLPAIVAGNAVVWKPAEETPLTARAFVEVYQEAGLPAGVLNVVFGDGPVVGEAMLHHPGIDVISFTGSTETGRHIASRAGANLKRVSLEMGGKNAITVLADADLDLAVDAILWSAYGTSGQRCTAASRVIVEREAEEALLARLLPRVQALRVGDGLDPAVNVGPVIHEEALAKIDRYVRLGVDEGARLLTGGRRLTEGPLARGFYYAPTVFAGVRPDMRIAQEEIFGPVLCVMAVDSFEEAIRVNNGVRYGLSASIFTRDVNRVFRAMRDLDTGIVYVNAGTTGAEIHLPFGGTKATGNGHRDSGQAALDVFTEWKTVYVDYSGRLQRAQIDNN

SEQ ID NO: 1558 - protein, 499 aa, Artificial
  Substituion in SEQ ID NO 1548
MRRMHRFDPCLNFIGGRWREPKTGQYGDNVNPANGEVLGVWARSGPDDLDDAVRAAREAQAAWRLVPAPERAKVLRRVADLLRDRKDEIARTLTMEMGKVIEEARGEVQEAIDMAEYMAGEGRRLFGQTTPSELPDKFAMSVRVPVGVVGIITPWNFPIAIASWKSLPAIVAGNAVVWKPAEETPLTARAFVEVYQEAGLPAGVLNVVFGDGPVVGEAMLHHPGIDVISFTGSTETGRHIASRAGANLKRVSLEMGGKNAITVLADADLDLAVDAILWSAYGTSGQRCTAASRVIVEREAEEALLARLLPRVQALRVGDGLDPAVNVGPVIHEEALAKIDRYVRLGVDEGARLLTGGRRLTEGPLARGFYYAPTVFAGVRPDMRIAQEEIFGPVLCVMAVDSFEEAIRVNNGVRYGLSASIFTRDVNRVFRAMRDLDTGIVYVNAGTTGAEIHLPFGGTKATGNGHRDSGQAALDVFTEWKTVYVDYSGRLQRAQIDNN

SEQ ID NO: 1559 - protein, 499 aa, Artificial
  Substituion in SEQ ID NO 1548
MRRMHRFEPCLNFIGGRWREPKTGQYGDNVNPANGEVLGVWARSGPDDLDDAVKAAREAQAAWRLVPAPERAKVLRRVADLLRDRKDEIARTLTMEMGKVIEEARGEVQEAIDMAEYMAGEGRRLFGQTTPSELPDKFAMSVRVPVGVVGIITPWNFPIAIASWKSLPAIVAGNAVVWKPAEETPLTARAFVEVYQEAGLPAGVLNVVFGDGPVVGEAMLHHPGIDVISFTGSTETGRHIASRAGANLKRVSLEMGGKNAITVLADADLDLAVDAILWSAYGTSGQRCTAASRVIVEREAEEALLARLLPRVQALRVGDGLDPAVNVGPVIHEEALAKIDRYVRLGVDEGARLLTGGRRLTEGPLARGFYYAPTVFAGVRPDMRIAQEEIFGPVLCVMAVDSFEEAIRVNNGVRYGLSASIFTRDVNRVFRAMRDLDTGIVYVNAGTTGAEIHLPFGGTKATGNGHRDSGQAALDVFTEWKTVYVDYSGRLQRAQIDNN

SEQ ID NO: 1560 - DNA, 1500 bp, Artificial
  Substituion in SEQ ID NO 1549
gtgaggcgcatgcatcggtttgagccttgtctgaatttcatcggcggcaggtggcgcgagcccaagacggggcagtacggggacaacgtcaaccccgcaaacggcgaggtgctcggggtgtgggcgagatcgggcccggacgatctcgacgacgccgtgcgggcggcccgcgaggcgcaggccgcgtggcgcctggtgcccgctccggagcgcgcgaaggtgctgcggcgcgtcgcggatctgctgcgggatcgcaaggacgagatcgcgcggacgctgacaatggagatgggcaaggtcatcgaggaggcgcgcggcgaggtgcaggaggccatcgacatggccgagtacatggcgggcgaggggcgaaggctgttcggccagacgacgccctcggaacttcccgacaagttcgccatgagcgtgcgcgttccggtgggcgtggtggggatcatcacgccgtggaacttccccatcgccatcgcgtcgtggaagtcgcttccggccatcgtcgccggcaacgccgtggtgtggaagcccgcggaggagacaccgctcaccgcgcgggcgttcgtggaggtgtatcaggaggccgggctgcctgcgggcgttctgaacgtggtgttcggcgatggccccgtggtcggcgaggcgatgctccatcaccccgggatcgacgtcatctccttcaccggatcgacggagacggggcggcacatcgcgagccgtgcgggtgcgaatctgaagcgcgtgtccctcgagatgggcggcaaaaacgccatcacggtgctcgccgacgcggacctggacctcgccgtggacgccatcctctggagtgcctacggcacgagcggccagcggtgcaccgcggcgagccgcgtgatcgtggagcgcgaggcggaggaagcgttgctcgctcgcttgctgccgcgcgtgcaggcgctccgcgtcggcgacgggctggatccggccgtcaacgtcgggcccgtcatccacgaggaagccctcgcgaagatcgaccggtacgtgcggattggcgtggacgagggtgcgcggctcttgactggcggccgcaggctgacggagggcccgctggcgcgcggcttttactatgcgccgaccgtgttcgccggcgtccgccccgacatgcgcatcgcgcaggaggagatcttcggcccggtgctctgcgtgatggccgtcgactcgttcgaggaagccatccgcgtcaacaacggggttcgctacgggctctcggccagcatcttcacgcgcgacgtcaaccgcgtgtttcgcgccatgcgcgatctcgacaccgggatcgtgtacgtcaacgcgggcacgacgggcgccgaaattcacctgccgttcggcggtaccaaggccaccggaaacgggcaccgagattccggccaggccgccttggacgtcttcacggagtggaagaccgtgtacgtcgattacagcggccggctgcagcgcgcgcagatcgacaacaactga

SEQ ID NO: 1561 - DNA, 1500 bp, Artificial
  Substituion in SEQ ID NO 1549
gtgaggcgcatgcatcggtttgagccttgtctgaatttcatcggcggcaggtggcgcgagcccaagacggggcagtacggggacaacgtcaaccccgcaaacggcgaggtgctcggggtgtgggcgagatcgggcccggacgatctcgacgacgccgtgcgggcggcccgcgaggcgcaggccgcgtggcgcctggtgcccgctccggagcgcgcgaaggtgctgcggcgcgtcgcggatctgctgcgggatcgcaaggacgagatcgcgcggacgctgacaatggagatgggcaaggtcatcgaggaggcgcgcggcgaggtgcaggaggccatcgacatggccgagtacatggcgggcgaggggcgaaggattttcggccagacgacgccctcggaacttcccgacaagttcgccatgagcgtgcgcgttccggtgggcgtggtggggatcatcacgccgtggaacttccccatcgccatcgcgtcgtggaagtcgcttccggccatcgtcgccggcaacgccgtggtgtggaagcccgcggaggagacaccgctcaccgcgcgggcgttcgtggaggtgtatcaggaggccgggctgcctgcgggcgttctgaacgtggtgttcggcgatggccccgtggtcggcgaggcgatgctccatcaccccgggatcgacgtcatctccttcaccggatcgacggagacggggcggcacatcgcgagccgtgcgggtgcgaatctgaagcgcgtgtccctcgagatgggcggcaaaaacgccatcacggtgctcgccgacgcggacctggacctcgccgtggacgccatcctctggagtgcctacggcacgagcggccagcggtgcaccgcggcgagccgcgtgatcgtggagcgcgaggcggaggaagcgttgctcgctcgcttgctgccgcgcgtgcaggcgctccgcgtcggcgacgggctggatccggccgtcaacgtcgggcccgtcatccacgaggaagccctcgcgaagatcgaccggtacgtgcggctcggcgtggacgagggtgcgcggctcttgactggcggccgcaggctgacggagggcccgctggcgcgcggcttttactatgcgccgaccgtgttcgccggcgtccgccccgacatgcgcatcgcgcaggaggagatcttcggcccggtgctctgcgtgatggccgtcgactcgttcgaggaagccatccgcgtcaacaacggggttcgctacgggctctcggccagcatcttcacgcgcgacgtcaaccgcgtgtttcgcgccatgcgcgatctcgacaccgggatcgtgtacgtcaacgcgggcacgacgggcgccgaaattcacctgccgttcggcggtaccaaggccaccggaaacgggcaccgagattccggccaggccgccttggacgtcttcacggagtggaagaccgtgtacgtcgattacagcggccggctgcagcgcgcgcagatcgacaacaactga

SEQ ID NO: 1562 - DNA, 1500 bp, Artificial
  Substituion in SEQ ID NO 1549
gtgaggcgcatgcatcggtttgagccttgtctgaatttcatcggcggcaggtggcgcgagcccaagacggggcagtacggggacaacgtcaaccccgcaaacggcgaggtgctcggggtgtgggcgagatcgggcccggacgatctcgacgacgccgtgcgggcggcccgcgaggcgcaggccgcgtggaaactggtgcccgctccggagcgcgcgaaggtgctgcggcgcgtcgcggatctgctgcgggatcgcaaggacgagatcgcgcggacgctgacaatggagatgggcaaggtcatcgaggaggcgcgcggcgaggtgcaggaggccatcgacatggccgagtacatggcgggcgaggggcgaaggctgttcggccagacgacgccctcggaacttcccgacaagttcgccatgagcgtgcgcgttccggtgggcgtggtggggatcatcacgccgtggaacttccccatcgccatcgcgtcgtggaagtcgcttccggccatcgtcgccggcaacgccgtggtgtggaagcccgcggaggagacaccgctcaccgcgcgggcgttcgtggaggtgtatcaggaggccgggctgcctgcgggcgttctgaacgtggtgttcggcgatggccccgtggtcggcgaggcgatgctccatcaccccgggatcgacgtcatctccttcaccggatcgacggagacggggcggcacatcgcgagccgtgcgggtgcgaatctgaagcgcgtgtccctcgagatgggcggcaaaaacgccatcacggtgctcgccgacgcggacctggacctcgccgtggacgccatcctctggagtgcctacggcacgagcggccagcggtgcaccgcggcgagccgcgtgatcgtggagcgcgaggcggaggaagcgttgctcgctcgcttgctgccgcgcgtgcaggcgctccgcgtcggcgacgggctggatccggccgtcaacgtcgggcccgtcatccacgaggaagccctcgcgaagatcgaccggtacgtgcggctcggcgtggacgagggtgcgcggctcttgactggcggccgcaggctgacggagggcccgctggcgcgcggcttttactatgcgccgaccgtgttcgccggcgtccgccccgacatgcgcatcgcgcaggaggagatcttcggcccggtgctctgcgtgatggccgtcgactcgttcgaggaagccatccgcgtcaacaacggggttcgctacgggctctcggccagcatcttcacgcgcgacgtcaaccgcgtgtttcgcgccatgcgcgatctcgacaccgggatcgtgtacgtcaacgcgggcacgacgggcgccgaaattcacctgccgttcggcggtaccaaggccaccggaaacgggcaccgagattccggccaggccgccttggacgtcttcacggagtggaagaccgtgtacgtcgattacagcggccggctgcagcgcgcgcagatcgacaacaactga

SEQ ID NO: 1563 - DNA, 1500 bp, Artificial
  Substituion in SEQ ID NO 1549
gtgaggcgcatgcatcggtttgatccttgtctgaatttcatcggcggcaggtggcgcgagcccaagacggggcagtacggggacaacgtcaaccccgcaaacggcgaggtgctcggggtgtgggcgagatcgggcccggacgatctcgacgacgccgtgcgggcggcccgcgaggcgcaggccgcgtggcgcctggtgcccgctccggagcgcgcgaaggtgctgcggcgcgtcgcggatctgctgcgggatcgcaaggacgagatcgcgcggacgctgacaatggagatgggcaaggtcatcgaggaggcgcgcggcgaggtgcaggaggccatcgacatggccgagtacatggcgggcgaggggcgaaggctgttcggccagacgacgccctcggaacttcccgacaagttcgccatgagcgtgcgcgttccggtgggcgtggtggggatcatcacgccgtggaacttccccatcgccatcgcgtcgtggaagtcgcttccggccatcgtcgccggcaacgccgtggtgtggaagcccgcggaggagacaccgctcaccgcgcgggcgttcgtggaggtgtatcaggaggccgggctgcctgcgggcgttctgaacgtggtgttcggcgatggccccgtggtcggcgaggcgatgctccatcaccccgggatcgacgtcatctccttcaccggatcgacggagacggggcggcacatcgcgagccgtgcgggtgcgaatctgaagcgcgtgtccctcgagatgggcggcaaaaacgccatcacggtgctcgccgacgcggacctggacctcgccgtggacgccatcctctggagtgcctacggcacgagcggccagcggtgcaccgcggcgagccgcgtgatcgtggagcgcgaggcggaggaagcgttgctcgctcgcttgctgccgcgcgtgcaggcgctccgcgtcggcgacgggctggatccggccgtcaacgtcgggcccgtcatccacgaggaagccctcgcgaagatcgaccggtacgtgcggctcggcgtggacgagggtgcgcggctcttgactggcggccgcaggctgacggagggcccgctggcgcgcggcttttactatgcgccgaccgtgttcgccggcgtccgccccgacatgcgcatcgcgcaggaggagatcttcggcccggtgctctgcgtgatggccgtcgactcgttcgaggaagccatccgcgtcaacaacggggttcgctacgggctctcggccagcatcttcacgcgcgacgtcaaccgcgtgtttcgcgccatgcgcgatctcgacaccgggatcgtgtacgtcaacgcgggcacgacgggcgccgaaattcacctgccgttcggcggtaccaaggccaccggaaacgggcaccgagattccggccaggccgccttggacgtcttcacggagtggaagaccgtgtacgtcgattacagcggccggctgcagcgcgcgcagatcgacaacaactga

SEQ ID NO: 1564 - DNA, 1500 bp, Artificial
  Substituion in SEQ ID NO 1549
gtgaggcgcatgcatcggtttgagccttgtctgaatttcatcggcggcaggtggcgcgagcccaagacggggcagtacggggacaacgtcaaccccgcaaacggcgaggtgctcggggtgtgggcgagatcgggcccggacgatctcgacgacgccgtgaaagcggcccgcgaggcgcaggccgcgtggcgcctggtgcccgctccggagcgcgcgaaggtgctgcggcgcgtcgcggatctgctgcgggatcgcaaggacgagatcgcgcggacgctgacaatggagatgggcaaggtcatcgaggaggcgcgcggcgaggtgcaggaggccatcgacatggccgagtacatggcgggcgaggggcgaaggctgttcggccagacgacgccctcggaacttcccgacaagttcgccatgagcgtgcgcgttccggtgggcgtggtggggatcatcacgccgtggaacttccccatcgccatcgcgtcgtggaagtcgcttccggccatcgtcgccggcaacgccgtggtgtggaagcccgcggaggagacaccgctcaccgcgcgggcgttcgtggaggtgtatcaggaggccgggctgcctgcgggcgttctgaacgtggtgttcggcgatggccccgtggtcggcgaggcgatgctccatcaccccgggatcgacgtcatctccttcaccggatcgacggagacggggcggcacatcgcgagccgtgcgggtgcgaatctgaagcgcgtgtccctcgagatgggcggcaaaaacgccatcacggtgctcgccgacgcggacctggacctcgccgtggacgccatcctctggagtgcctacggcacgagcggccagcggtgcaccgcggcgagccgcgtgatcgtggagcgcgaggcggaggaagcgttgctcgctcgcttgctgccgcgcgtgcaggcgctccgcgtcggcgacgggctggatccggccgtcaacgtcgggcccgtcatccacgaggaagccctcgcgaagatcgaccggtacgtgcggctcggcgtggacgagggtgcgcggctcttgactggcggccgcaggctgacggagggcccgctggcgcgcggcttttactatgcgccgaccgtgttcgccggcgtccgccccgacatgcgcatcgcgcaggaggagatcttcggcccggtgctctgcgtgatggccgtcgactcgttcgaggaagccatccgcgtcaacaacggggttcgctacgggctctcggccagcatcttcacgcgcgacgtcaaccgcgtgtttcgcgccatgcgcgatctcgacaccgggatcgtgtacgtcaacgcgggcacgacgggcgccgaaattcacctgccgttcggcggtaccaaggccaccggaaacgggcaccgagattccggccaggccgccttggacgtcttcacggagtggaagaccgtgtacgtcgattacagcggccggctgcagcgcgcgcagatcgacaacaactga

SEQ ID NO: 1565 - protein, 341 aa, Alicyclobacillus acidocaldarius
MVAGRDGGHGLGTQRSRRTVRDDGRACGWVYQMRLRGGRVMGAEKDVYSRLRGSIVPMVTPFLEDGSFDEKSYRELIEWQIESGSHGISCAGTTGEPSSLTIEEREYLFEVTMDAVRGRVPVVLGTGSTNHAEALRLTKTAERLGADAALVIVPYYNRPSQEGLYRHFRAIADSVDIPIILYNIPGRTGVNLEPATMARLKRDCRNIIGVKESNKDFEQVTRVFQACGRDFLVYSGIELLCYPMLALGGAGHLSATANLMPREVARLYDLVQAGKWHEAIDLHFQLVDINEALFWETNPGPVKACLAMMGKIRPVVRPPLALPGEEMTAKLRGVLTSYGLI

SEQ ID NO: 1566 - DNA, 1026 bp, Alicyclobacillus acidocaldarius
ttggtggcgggacgggacggtggtcatggattgggaacgcaacgttcccgtcgaactgtgcgggacgacggacgcgcgtgcggctgggtatatcaaatgagactgcgagggggacgggtcatgggcgccgaaaaggacgtgtattcgcgccttcggggatccatcgtgccgatggtcacgccgtttttggaggacggatcgtttgacgagaagtcgtatcgtgaactcattgagtggcagatcgagagcggttctcacggtatctcttgcgcaggaacaactggagaaccgagttcccttacgatagaagaacgagaatacttattcgaagtcacgatggatgccgtgcgcggtcgggtgcctgtggtgttggggacgggctcgacgaaccacgcggaggcgcttcggctcacgaagacggctgaacggctgggtgcggatgccgcgctggtcatcgttccgtattacaaccgtccgtcccaggaggggctctaccggcactttcgcgcgatagcggacagcgtcgacattcccatcatcctgtacaacattccgggacgcaccggggtgaacctagagcccgccacgatggcccggctcaagcgcgactgccgtaacatcattggcgtcaaggaatcgaacaaggactttgagcaggttacacgcgtgttccaggcctgcggccgcgatttcctggtctattccggcatagagctcctgtgttaccccatgctcgcgctgggaggagcggggcatctcagcgcgaccgccaatctcatgccgagagaagtcgcccgcctgtacgacttggtgcaagccgggaagtggcatgaagcgatcgatcttcactttcaactggtcgacatcaatgaggctttgttctgggagacgaacccaggtccggtcaaggcgtgccttgccatgatgggcaaaattcggcccgtggtgaggccgccgctcgcgctgccaggagaggaaatgacggcaaagctgcgaggcgtgctgacttcgtatgggctgatctga

SEQ ID NO: 1567 - protein, 299 aa, Geobacillus thermodenitrificans NG80-2
AYREVKERLRGSIAPVVTPFDEEGNVDLTTLTSLIDWHIKSGTHGISVTGTSGEPSSLTLDERKQVMETAKKAVAGRVPFVPGTGSTNHAETIELTKFAQEIGADAAMVIVPYYNRPSQQALYKHFKAVAESVDIPIIVYNIPGRTAVNLEVKTLARLVEDCPNIIGVKESNKDFEHVNRVLWHCGRDFLLFSGIELLCYPMLAIGGAGSISATANVVPQKVAELHDAWFDGDVKRAQDLHFELMELNDVLFIETNPGPVKAALGMLGKITPKLRLPLDLPSEEHQEQIRRTLVKYGLL

SEQ ID NO: 1568 - protein, 299 aa, Geobacillus kaustophilus HTA426
AYHEAKERLRGSIAPVVTPFDEEGNVDFAALAALIDWHIESGTHGISVTGTSGEPSSLTLEERKQVMETAKKAVAGRVPFVPGTGSTNHAETIELTKFAQEIGADAAMVIVPYYNRPSQQALYKHFKAVAEAVDIPIIVYNIPGRTAVNLEVKTLARLAEDCPNIIGVKESNKDFEHVNRVLWHCGRDFLLFSGIELLCYPMLAIGGAGSISATANVVPHKVAELHDAWFEGDIKRAQDLHFELMELNDVLFIETNPGPVKAALGMMGKITPKLRLPLDLPSEEHQQQIRRTLVKYGLL

SEQ ID NO: 1569 - protein, 289 aa, Bacillus cereus subsp. cytotoxis NVH 391-98
KLRGSIAPIITPFDESGAIDFQTFENLIHWHIESGSHGISVTGTTGEPSSLKVEERVKVMETAAKAINGRVPFAPGTGSTNHEETLYLTKKAQEIGADAALVIVPYYNKPSQHALYKHFKTVADSVDIPIIIYNIPGRTAVNLQVETIAKLNQDCPNIIGIKESNKDFEHINRVLLHCGRDFLLFSGIELLCYPMLAIGGAGHISATANVAPKQVAEVYNAWNEGDIKRALTLHYELMPLNDVLFKDTNPAPVKAALGMMGKIKPVLRLPMDVPSQELQDEIRDVLKNY

SEQ ID NO: 1570 - protein, 295 aa, Oceanobacillus iheyensis HTE831
IKKRLRGSIAPVITPFKVNGDIDFKKQSELIEFQIENGTHAISVTGTSGEPSSLTTEERVQVMENAIKTINGRIPFAPGTGSTNHDETMYVTKKAEEMGADAAMVIVPYYNKPNQEALYDHFKTVADSVDIPIIIYNIPGRTAQNMEVKTMARLVKDCPNIVGAKESNKDFEHVNRVLLNCGRDFLLFSGIELLCYPMLAIGGAGSISATANVEPKKVAEMHNAWEEGDIKRAQDLHFELMNLNDVLFKDTNPAPVKAALGMMGMIEPVLRRPMGLPSDALQEEIRDTLVKYGKI

SEQ ID NO: 1571 - protein, 290 aa, Thermus thermophilus HB8
RGSIPPLPTPFRRGRLDEEALRRLVERVVQGGSHGVSVGGTTGEPGTQTLEERKRAIEVVLDQVAGRVPVIPGTGALRLEETLELTRFAKEAGAQGAMVIVPYYVKPNQEGLYRYFAEVARTVPDFPLLIYNIPGRAGVEIAPKTVGRLRRDFPNIVGLKHSSKDLEYLSHLFLEAGRDFLVFCGLESLTLPMMSLGAVGTIAATANWLPKEVALLCEKALAGDYQGARELHFHLLEANEAIFWDTNPIPLKTVLSWMGLLEKEWRPPLGPTTPEVEERLRRMAERYGLL

SEQ ID NO: 1572 - protein, 341 aa, Artificial
  Substituion in SEQ ID NO 1565
MVAGRDGGHGLGTQRSRRTIRDDGRACGWVYQMRLRGGRVMGAEKDVYSRLRGSIVPMVTPFLEDGSFDEKSYRELIEWQIESGSHGISCAGTTGEPSSLTIEEREYLFEVTMDAVRGRVPVVLGTGSTNHAEALRLTKTAERLGADAALVIVPYYNRPSQEGLYRHFRAIADSVDIPIILYNIPGRTGVNLEPATMARLKRDCRNIIGVKESNKDFEQVTRVFQACGRDFLVYSGIELLCYPMLALGGAGHLSATANLMPREVARLYDLVQAGKWHEAIDLHFQLVDINEALFWETNPGPVKACLAMMGKIRPVVRPPLALPGEEMTAKLRGVLTSYGLI

SEQ ID NO: 1573 - protein, 341 aa, Artificial
  Substituion in SEQ ID NO 1565
MVAGRDGGHGLGTQRSRRTVRDDGRACGWVYQMRLRGGRVMGAEKDVYSRLRGSIVPMVTPFLEDGSFDEKSYRELIEWQIESGSHGISCAGTTGEPSSLTIEEREYLFEVTMDAVRGRVPVVLGTGSTNHAEALRLTKTAERLGADAALVIVPYYNRPSQEGLYRHFRAIADSVDIPIILYNIPGRTGVNLEPATMARLKRDCRNIIGVKESNKDFEQVTRVFQACGRDFLVYSGIELLCYPMLALGGAGHLSATANLMPREVARLYDIVQAGKWHEAIDLHFQLVDINEALFWETNPGPVKACLAMMGKIRPVVRPPLALPGEEMTAKLRGVLTSYGLI

SEQ ID NO: 1574 - protein, 341 aa, Artificial
  Substituion in SEQ ID NO 1565
MVAGRDGGHGLGTQRSRRTVRDDGRACGWVYQMRLRGGRVMGAEKDVYSRLRGSIVPMVTPFLEDGSFDEKSYRELIEWQIESGSHGISCAGTTGEPSSLTIEEREYLFEVTMDAVRGRVPVVLGTGSTNHAEALRLTKTAERLGADAALVIVPYYNRPSQEGLYRHFRAIADSVDIPIILYNIPGRTGVNLEPATMARLRRDCRNIIGVKESNKDFEQVTRVFQACGRDFLVYSGIELLCYPMLALGGAGHLSATANLMPREVARLYDLVQAGKWHEAIDLHFQLVDINEALFWETNPGPVKACLAMMGKIRPVVRPPLALPGEEMTAKLRGVLTSYGLI

SEQ ID NO: 1575 - protein, 341 aa, Artificial
  Substituion in SEQ ID NO 1565
MVAGRDGGHGLGTQRSRRTVRDDGRACGWVYQMRLRGGRVMGAEKDVYSRLRGSIVPMVTPFLEDGSFDEKSYRELIEWQIESGSHGISCAGTTGEPSSLTIEEREYLFEVTMDAVKGRVPVVLGTGSTNHAEALRLTKTAERLGADAALVIVPYYNRPSQEGLYRHFRAIADSVDIPIILYNIPGRTGVNLEPATMARLKRDCRNIIGVKESNKDFEQVTRVFQACGRDFLVYSGIELLCYPMLALGGAGHLSATANLMPREVARLYDLVQAGKWHEAIDLHFQLVDINEALFWETNPGPVKACLAMMGKIRPVVRPPLALPGEEMTAKLRGVLTSYGLI

SEQ ID NO: 1576 - protein, 341 aa, Artificial
  Substituion in SEQ ID NO 1565
MVAGRDGGHGLGTQRSRRTVRDDGRACGWVYQMRLRGGRVMGAEKDVYSRLRGSIVPMVTPFLEDGSFDEKSYRELIEWQIESGSHGISCAGTTGEPSSLTIEEREYLFEVTMDAVRGRVPVVLGTGSTNHAEALRLTKTAERLGADAALVIVPYYNRPSQEGLYRHFRAIADSVDIPIILYNIPGRTGVNLEPATMARLKRDCRNIIGVKESNKDFEQVTRVFQACGRDFLVYSGIELLCYPMLALGGAGHLSATANLMPREVARLYDLVQAGKWHEAIDLHFQLVDLNEALFWETNPGPVKACLAMMGKIRPVVRPPLALPGEEMTAKLRGVLTSYGLI

SEQ ID NO: 1577 - DNA, 1026 bp, Artificial
  Substituion in SEQ ID NO 1566
ttggtggcgggacgggacggtggtcatggattgggaacgcaacgttcccgtcgaactattcgggacgacggacgcgcgtgcggctgggtatatcaaatgagactgcgagggggacgggtcatgggcgccgaaaaggacgtgtattcgcgccttcggggatccatcgtgccgatggtcacgccgtttttggaggacggatcgtttgacgagaagtcgtatcgtgaactcattgagtggcagatcgagagcggttctcacggtatctcttgcgcaggaacaactggagaaccgagttcccttacgatagaagaacgagaatacttattcgaagtcacgatggatgccgtgcgcggtcgggtgcctgtggtgttggggacgggctcgacgaaccacgcggaggcgcttcggctcacgaagacggctgaacggctgggtgcggatgccgcgctggtcatcgttccgtattacaaccgtccgtcccaggaggggctctaccggcactttcgcgcgatagcggacagcgtcgacattcccatcatcctgtacaacattccgggacgcaccggggtgaacctagagcccgccacgatggcccggctcaagcgcgactgccgtaacatcattggcgtcaaggaatcgaacaaggactttgagcaggttacacgcgtgttccaggcctgcggccgcgatttcctggtctattccggcatagagctcctgtgttaccccatgctcgcgctgggaggagcggggcatctcagcgcgaccgccaatctcatgccgagagaagtcgcccgcctgtacgacttggtgcaagccgggaagtggcatgaagcgatcgatcttcactttcaactggtcgacatcaatgaggctttgttctgggagacgaacccaggtccggtcaaggcgtgccttgccatgatgggcaaaattcggcccgtggtgaggccgccgctcgcgctgccaggagaggaaatgacggcaaagctgcgaggcgtgctgacttcgtatgggctgatctga

SEQ ID NO: 1578 - DNA, 1026 bp, Artificial
  Substituion in SEQ ID NO 1566
ttggtggcgggacgggacggtggtcatggattgggaacgcaacgttcccgtcgaactgtgcgggacgacggacgcgcgtgcggctgggtatatcaaatgagactgcgagggggacgggtcatgggcgccgaaaaggacgtgtattcgcgccttcggggatccatcgtgccgatggtcacgccgtttttggaggacggatcgtttgacgagaagtcgtatcgtgaactcattgagtggcagatcgagagcggttctcacggtatctcttgcgcaggaacaactggagaaccgagttcccttacgatagaagaacgagaatacttattcgaagtcacgatggatgccgtgcgcggtcgggtgcctgtggtgttggggacgggctcgacgaaccacgcggaggcgcttcggctcacgaagacggctgaacggctgggtgcggatgccgcgctggtcatcgttccgtattacaaccgtccgtcccaggaggggctctaccggcactttcgcgcgatagcggacagcgtcgacattcccatcatcctgtacaacattccgggacgcaccggggtgaacctagagcccgccacgatggcccggctcaagcgcgactgccgtaacatcattggcgtcaaggaatcgaacaaggactttgagcaggttacacgcgtgttccaggcctgcggccgcgatttcctggtctattccggcatagagctcctgtgttaccccatgctcgcgctgggaggagcggggcatctcagcgcgaccgccaatctcatgccgagagaagtcgcccgcctgtacgacattgtgcaagccgggaagtggcatgaagcgatcgatcttcactttcaactggtcgacatcaatgaggctttgttctgggagacgaacccaggtccggtcaaggcgtgccttgccatgatgggcaaaattcggcccgtggtgaggccgccgctcgcgctgccaggagaggaaatgacggcaaagctgcgaggcgtgctgacttcgtatgggctgatctga

SEQ ID NO: 1579 - DNA, 1026 bp, Artificial
  Substituion in SEQ ID NO 1566
ttggtggcgggacgggacggtggtcatggattgggaacgcaacgttcccgtcgaactgtgcgggacgacggacgcgcgtgcggctgggtatatcaaatgagactgcgagggggacgggtcatgggcgccgaaaaggacgtgtattcgcgccttcggggatccatcgtgccgatggtcacgccgtttttggaggacggatcgtttgacgagaagtcgtatcgtgaactcattgagtggcagatcgagagcggttctcacggtatctcttgcgcaggaacaactggagaaccgagttcccttacgatagaagaacgagaatacttattcgaagtcacgatggatgccgtgcgcggtcgggtgcctgtggtgttggggacgggctcgacgaaccacgcggaggcgcttcggctcacgaagacggctgaacggctgggtgcggatgccgcgctggtcatcgttccgtattacaaccgtccgtcccaggaggggctctaccggcactttcgcgcgatagcggacagcgtcgacattcccatcatcctgtacaacattccgggacgcaccggggtgaacctagagcccgccacgatggcccggctccgtcgcgactgccgtaacatcattggcgtcaaggaatcgaacaaggactttgagcaggttacacgcgtgttccaggcctgcggccgcgatttcctggtctattccggcatagagctcctgtgttaccccatgctcgcgctgggaggagcggggcatctcagcgcgaccgccaatctcatgccgagagaagtcgcccgcctgtacgacttggtgcaagccgggaagtggcatgaagcgatcgatcttcactttcaactggtcgacatcaatgaggctttgttctgggagacgaacccaggtccggtcaaggcgtgccttgccatgatgggcaaaattcggcccgtggtgaggccgccgctcgcgctgccaggagaggaaatgacggcaaagctgcgaggcgtgctgacttcgtatgggctgatctga

SEQ ID NO: 1580 - DNA, 1026 bp, Artificial
  Substituion in SEQ ID NO 1566
ttggtggcgggacgggacggtggtcatggattgggaacgcaacgttcccgtcgaactgtgcgggacgacggacgcgcgtgcggctgggtatatcaaatgagactgcgagggggacgggtcatgggcgccgaaaaggacgtgtattcgcgccttcggggatccatcgtgccgatggtcacgccgtttttggaggacggatcgtttgacgagaagtcgtatcgtgaactcattgagtggcagatcgagagcggttctcacggtatctcttgcgcaggaacaactggagaaccgagttcccttacgatagaagaacgagaatacttattcgaagtcacgatggatgccgtgaaaggtcgggtgcctgtggtgttggggacgggctcgacgaaccacgcggaggcgcttcggctcacgaagacggctgaacggctgggtgcggatgccgcgctggtcatcgttccgtattacaaccgtccgtcccaggaggggctctaccggcactttcgcgcgatagcggacagcgtcgacattcccatcatcctgtacaacattccgggacgcaccggggtgaacctagagcccgccacgatggcccggctcaagcgcgactgccgtaacatcattggcgtcaaggaatcgaacaaggactttgagcaggttacacgcgtgttccaggcctgcggccgcgatttcctggtctattccggcatagagctcctgtgttaccccatgctcgcgctgggaggagcggggcatctcagcgcgaccgccaatctcatgccgagagaagtcgcccgcctgtacgacttggtgcaagccgggaagtggcatgaagcgatcgatcttcactttcaactggtcgacatcaatgaggctttgttctgggagacgaacccaggtccggtcaaggcgtgccttgccatgatgggcaaaattcggcccgtggtgaggccgccgctcgcgctgccaggagaggaaatgacggcaaagctgcgaggcgtgctgacttcgtatgggctgatctga

SEQ ID NO: 1581 - DNA, 1026 bp, Artificial
  Substituion in SEQ ID NO 1566
ttggtggcgggacgggacggtggtcatggattgggaacgcaacgttcccgtcgaactgtgcgggacgacggacgcgcgtgcggctgggtatatcaaatgagactgcgagggggacgggtcatgggcgccgaaaaggacgtgtattcgcgccttcggggatccatcgtgccgatggtcacgccgtttttggaggacggatcgtttgacgagaagtcgtatcgtgaactcattgagtggcagatcgagagcggttctcacggtatctcttgcgcaggaacaactggagaaccgagttcccttacgatagaagaacgagaatacttattcgaagtcacgatggatgccgtgcgcggtcgggtgcctgtggtgttggggacgggctcgacgaaccacgcggaggcgcttcggctcacgaagacggctgaacggctgggtgcggatgccgcgctggtcatcgttccgtattacaaccgtccgtcccaggaggggctctaccggcactttcgcgcgatagcggacagcgtcgacattcccatcatcctgtacaacattccgggacgcaccggggtgaacctagagcccgccacgatggcccggctcaagcgcgactgccgtaacatcattggcgtcaaggaatcgaacaaggactttgagcaggttacacgcgtgttccaggcctgcggccgcgatttcctggtctattccggcatagagctcctgtgttaccccatgctcgcgctgggaggagcggggcatctcagcgcgaccgccaatctcatgccgagagaagtcgcccgcctgtacgacttggtgcaagccgggaagtggcatgaagcgatcgatcttcactttcaactggtcgacttaaatgaggctttgttctgggagacgaacccaggtccggtcaaggcgtgccttgccatgatgggcaaaattcggcccgtggtgaggccgccgctcgcgctgccaggagaggaaatgacggcaaagctgcgaggcgtgctgacttcgtatgggctgatctga

What is claimed is:

1. An expression vector comprising an isolated polynucleotide encoding a polypeptide having at least 90% sequence identity to SEQ ID NO:1395.

2. The expression vector of claim 1, wherein the expression vector comprises a polynucleotide having at least 90% identity to SEQ ID NO:1396.

3. The expression vector of claim 1, wherein the encoded polypeptide has L-lactate dehydrogenase enzymatic activity.

4. An expression vector comprising a polynucleotide encoding a polypeptide having at least 95% sequence identity to SEQ ID NO:1395.

5. The expression vector of claim 4, wherein the encoded polypeptide has L-lactate dehydrogenase enzymatic activity.

6. A method of modulating or altering metabolism in a cell, the method comprising: providing the expression vector of claim 3 to the cell and expressing the encoded polypeptide in the cell.

7. The method according to claim 6, further comprising glycosylating, or otherwise post-translationally modifying the encoded peptide in the cell.

* * * * *

UNITED STATES PATENT AND TRADEMARK OFFICE
CERTIFICATE OF CORRECTION

PATENT NO. : 8,728,803 B2  
APPLICATION NO. : 12/380551  
DATED : May 20, 2014  
INVENTOR(S) : Vicki S. Thompson et al.

It is certified that error appears in the above-identified patent and that said Letters Patent is hereby corrected as shown below:

On the title page:
In ITEM (56) References Cited:
OTHER PUBLICATIONS
Page 2, 1st column, 1st line of the
10th entry (line 40),    change "Functiona" to --Functional--
Page 2, 1st column, 2nd line of the
12th entry (line 47),    change "Quarlty" to --Quarterly--
Page 2, 1st column, 1st line of the
17th entry (line 61),    change "1911," to --1991,--

Signed and Sealed this
Sixteenth Day of February, 2016

Michelle K. Lee
*Director of the United States Patent and Trademark Office*